(12) United States Patent
Srivatsa Srinivasan et al.

(10) Patent No.: US 11,396,551 B2
(45) Date of Patent: *Jul. 26, 2022

(54) CHIMERIC ANTIGEN RECEPTORS TARGETING CD70

(71) Applicant: Pfizer Inc., New York, NY (US)

(72) Inventors: Surabhi Srivatsa Srinivasan, San Francisco, CA (US); Niranjana Aditi Nagarajan, Oakland, CA (US); Siler Panowski, Berkeley, CA (US); Yoon Park, Seoul (KR); Tao Sai, Foster City, CA (US); Barbra Johnson Sasu, San Francisco, CA (US); Thomas John Van Blarcom, Oakland, CA (US); Mathilde Brunnhilde Dusseaux, Creteil (FR); Roman Ariel Galetto, Paris (FR)

(73) Assignee: Pfizer Inc., New York, NY (US)

( * ) Notice: Subject to any disclaimer, the term of this patent is extended or adjusted under 35 U.S.C. 154(b) by 219 days.

This patent is subject to a terminal disclaimer.

(21) Appl. No.: 16/264,371

(22) Filed: Jan. 31, 2019

(65) Prior Publication Data

US 2019/0233528 A1 Aug. 1, 2019

Related U.S. Application Data

(60) Provisional application No. 62/775,246, filed on Dec. 4, 2018, provisional application No. 62/641,873, filed on Mar. 12, 2018, provisional application No. 62/641,869, filed on Mar. 12, 2018, provisional application No. 62/625,019, filed on Feb. 1, 2018, provisional application No. 62/625,009, filed on Feb. 1, 2018.

(51) Int. Cl.

| | |
|---|---|
| *C07K 16/28* | (2006.01) |
| *C07K 14/725* | (2006.01) |
| *A61K 39/00* | (2006.01) |
| *A61P 35/02* | (2006.01) |
| *A61P 35/04* | (2006.01) |

(52) U.S. Cl.
CPC ............ *C07K 16/2875* (2013.01); *A61K 39/001129* (2018.08); *A61K 39/001138* (2018.08); *A61P 35/02* (2018.01); *A61P 35/04* (2018.01); *C07K 14/7051* (2013.01); *A61K 2039/5156* (2013.01); *C07K 2317/622* (2013.01); *C07K 2317/92* (2013.01); *C07K 2317/94* (2013.01); *C07K 2319/02* (2013.01); *C07K 2319/03* (2013.01); *C07K 2319/33* (2013.01)

(58) Field of Classification Search
CPC ............ C07K 16/2875; C07K 14/7051; A61P 35/02; A61P 35/04; A61K 39/001138; A61K 39/001129
See application file for complete search history.

(56) References Cited

U.S. PATENT DOCUMENTS

| | | |
|---|---|---|
| 4,676,980 A | 6/1987 | Segal et al. |
| 4,683,195 A | 7/1987 | Mullis et al. |
| 4,683,202 A | 7/1987 | Mullis |
| 4,754,065 A | 6/1988 | Levenson et al. |
| 4,777,127 A | 10/1988 | Sun et al. |
| 4,800,159 A | 1/1989 | Mullis et al. |
| 4,816,567 A | 3/1989 | Cabilly et al. |
| 4,975,278 A | 12/1990 | Senter et al. |
| 5,037,743 A | 8/1991 | Welch et al. |
| 5,047,335 A | 9/1991 | Paulson et al. |
| 5,143,830 A | 9/1992 | Holland et al. |
| 5,219,740 A | 6/1993 | Miller et al. |
| 5,278,299 A | 1/1994 | Wong et al. |
| 5,422,120 A | 6/1995 | Kim |
| 5,500,362 A | 3/1996 | Robinson et al. |
| 5,510,261 A | 4/1996 | Goochee et al. |
| 5,530,101 A | 6/1996 | Queen et al. |
| 5,545,806 A | 8/1996 | Lonberg et al. |
| 5,545,807 A | 8/1996 | Surani et al. |
| 5,565,332 A | 10/1996 | Hoogenboom et al. |
| 5,569,825 A | 10/1996 | Lonberg et al. |
| 5,580,717 A | 12/1996 | Dower et al. |
| 5,580,859 A | 12/1996 | Feigner et al. |
| 5,585,089 A | 12/1996 | Queen et al. |
| 5,625,126 A | 4/1997 | Lonberg et al. |
| 5,633,425 A | 5/1997 | Lonberg et al. |

(Continued)

FOREIGN PATENT DOCUMENTS

| | | |
|---|---|---|
| EP | 0 345 242 A1 | 12/1989 |
| EP | 0 519 596 A1 | 12/1992 |

(Continued)

OTHER PUBLICATIONS

Aalberse, R.C. et al. (2002). "IgG4 breaking the rules," Immunology 105:9-19.

Aftimos, P. et al. (2017). "Dose-Escalation Study of the Anti-CD70 Antibody ARGX-110 in Advanced Malignancies," Clinical Cancer Research 23:6411-6420.

Al-Lazikani, B. et al. (1997). "Standard conformations for the Canonical structures of immunoglobulins," J. Molec. Biol. 273:927-948.

Armour, K.L. et al. (2003). "Differential binding to human FcγRIIa and FcγRIIb receptors by human IgG wildtype and mutant antibodies," Molecular Immunology 40:585-593.

(Continued)

*Primary Examiner* — Amy E Juedes
*Assistant Examiner* — Peter Johansen

(57) ABSTRACT

The disclosure provides CARs (CARs) that specifically bind to CD70. The disclosure further relates to engineered immune cells comprising such CARs, CAR-encoding nucleic acids, and methods of making such CARs, engineered immune cells, and nucleic acids. The disclosure further relates to therapeutic methods for use of these CARs and engineered immune cells comprising these CARs for the treatment of a condition associated with malignant cells expressing CD70 (e.g., cancer).

47 Claims, 15 Drawing Sheets

Specification includes a Sequence Listing.

(56) References Cited

U.S. PATENT DOCUMENTS

| | | | |
|---|---|---|---|
| 5,661,016 A | 8/1997 | Lonberg et al. | |
| 5,693,761 A | 12/1997 | Queen et al. | |
| 5,693,762 A | 12/1997 | Queen et al. | |
| 5,733,743 A | 3/1998 | Johnson et al. | |
| 5,750,373 A | 5/1998 | Garrard et al. | |
| 5,807,715 A | 9/1998 | Morrison et al. | |
| 5,814,482 A | 9/1998 | Dubensky, Jr. et al. | |
| 5,821,337 A | 10/1998 | Carter et al. | |
| 5,858,358 A | 1/1999 | June et al. | |
| 5,866,692 A | 2/1999 | Shitara et al. | |
| 5,883,223 A | 3/1999 | Gray | |
| 5,997,867 A | 12/1999 | Waldmann et al. | |
| 6,054,297 A | 4/2000 | Carter et al. | |
| 6,180,370 B1 | 1/2001 | Queen et al. | |
| 6,180,377 B1 | 1/2001 | Morgan et al. | |
| 6,210,671 B1 | 4/2001 | Co | |
| 6,265,150 B1 | 7/2001 | Terstappen et al. | |
| 6,331,415 B1 | 12/2001 | Cabilly et al. | |
| 6,350,861 B1 | 2/2002 | Co et al. | |
| 6,352,694 B1 | 3/2002 | June et al. | |
| 6,376,471 B1 | 4/2002 | Lawrence, III et al. | |
| 6,413,942 B1 | 7/2002 | Feigner et al. | |
| 6,436,908 B1 | 8/2002 | Koch et al. | |
| 6,534,055 B1 | 3/2003 | June et al. | |
| 6,692,964 B1 | 2/2004 | June et al. | |
| 6,737,056 B1 | 5/2004 | Presta | |
| 6,797,514 B2 | 9/2004 | Berenson et al. | |
| 6,867,041 B2 | 3/2005 | Berenson et al. | |
| 6,887,466 B2 | 5/2005 | June et al. | |
| 6,905,680 B2 | 6/2005 | June et al. | |
| 6,905,681 B1 | 6/2005 | June et al. | |
| 6,905,874 B2 | 6/2005 | Berenson et al. | |
| 7,067,318 B2 | 6/2006 | June et al. | |
| 7,144,575 B2 | 12/2006 | June et al. | |
| 7,172,869 B2 | 2/2007 | June et al. | |
| 7,175,843 B2 | 2/2007 | June et al. | |
| 7,232,566 B2 | 6/2007 | June et al. | |
| 7,314,622 B2 | 1/2008 | Arlen et al. | |
| 10,689,456 B2 * | 6/2020 | Wang | C07K 14/7051 |
| 2006/0121005 A1 | 6/2006 | Berenson et al. | |
| 2009/0028872 A1 | 1/2009 | Terret et al. | |
| 2013/0323214 A1 * | 12/2013 | Gottschalk | A61P 29/00 424/93.21 |
| 2016/0297884 A1 | 10/2016 | Kuo et al. | |
| 2016/0297885 A1 | 10/2016 | Kuo et al. | |
| 2017/0129961 A1 | 5/2017 | Raum et al. | |
| 2019/0233529 A1 | 8/2019 | Panowski et al. | |

FOREIGN PATENT DOCUMENTS

| | | |
|---|---|---|
| EP | 0 524 968 B1 | 6/1995 |
| EP | 2 335 744 A1 | 6/2011 |
| GB | 2200651 B | 6/1991 |
| WO | WO-87/04462 A1 | 7/1987 |
| WO | WO-90/07936 A1 | 7/1990 |
| WO | WO-90/11092 A1 | 10/1990 |
| WO | WO-91/00360 A1 | 1/1991 |
| WO | WO-91/02805 A2 | 3/1991 |
| WO | WO-91/02805 A3 | 3/1991 |
| WO | WO-91/14445 A1 | 10/1991 |
| WO | WO-92/20373 A1 | 11/1992 |
| WO | WO-93/03769 A1 | 3/1993 |
| WO | WO-93/06213 A1 | 4/1993 |
| WO | WO-93/10218 A1 | 5/1993 |
| WO | WO-93/11230 A1 | 6/1993 |
| WO | WO-93/19191 A1 | 9/1993 |
| WO | WO-93/25234 A1 | 12/1993 |
| WO | WO-93/25698 A1 | 12/1993 |
| WO | WO-94/03622 A1 | 2/1994 |
| WO | WO-94/04690 A1 | 3/1994 |
| WO | WO-94/12649 A2 | 6/1994 |
| WO | WO-94/12649 A3 | 6/1994 |
| WO | WO-94/23697 A1 | 10/1994 |
| WO | WO-94/28938 A1 | 12/1994 |
| WO | WO-95/00655 A1 | 1/1995 |
| WO | WO-95/07994 A2 | 3/1995 |
| WO | WO-95/07994 A3 | 3/1995 |
| WO | WO-95/11984 A2 | 5/1995 |
| WO | WO-95/11984 A3 | 5/1995 |
| WO | WO-95/13796 A1 | 5/1995 |
| WO | WO-95/30763 A2 | 11/1995 |
| WO | WO-95/30763 A3 | 11/1995 |
| WO | WO-96/17072 A2 | 6/1996 |
| WO | WO-96/17072 A3 | 6/1996 |
| WO | WO-97/42338 A1 | 11/1997 |
| WO | WO-99/58572 A1 | 11/1999 |
| WO | WO-01/27160 A1 | 4/2001 |
| WO | WO-2004/058184 A2 | 7/2004 |
| WO | WO-2004/058184 A3 | 7/2004 |
| WO | WO-2006/044643 A2 | 4/2006 |
| WO | WO-2006/044643 A3 | 4/2006 |
| WO | WO-2006/113909 A2 | 10/2006 |
| WO | WO-2006/113909 A3 | 10/2006 |
| WO | WO-2011/143545 A1 | 11/2011 |
| WO | 2012/058460 A2 | 5/2012 |
| WO | WO-2012/058458 A2 | 5/2012 |
| WO | WO-2012/058458 A3 | 5/2012 |
| WO | WO-2012/058460 A2 | 5/2012 |
| WO | WO-2012/058460 A3 | 5/2012 |
| WO | WO-2012/059882 A2 | 5/2012 |
| WO | WO-2012/059882 A3 | 5/2012 |
| WO | WO-2012/123586 A1 | 9/2012 |
| WO | WO-2013153391 A1 | 10/2013 |
| WO | WO-2014/039523 A1 | 3/2014 |
| WO | WO-2014/184143 A1 | 11/2014 |
| WO | WO-2014/184741 A1 | 11/2014 |
| WO | WO-2014/184744 A1 | 11/2014 |
| WO | WO-2014/191128 A1 | 11/2014 |
| WO | WO-2015/015448 A2 | 2/2015 |
| WO | WO-2015/015448 A3 | 2/2015 |
| WO | 2015/121454 A1 | 8/2015 |
| WO | WO-2015/121454 A1 | 8/2015 |
| WO | WO-2016/120126 A1 | 8/2016 |
| WO | WO-2016/120216 A1 | 8/2016 |
| WO | WO-2017/125831 A1 | 7/2017 |
| WO | WO-2017/134140 A1 | 8/2017 |
| WO | WO-2018/152181 A1 | 8/2018 |

OTHER PUBLICATIONS

Armour, K.L. et al. (1999). "Recombinant human IgG molecules lacking Fcγ receptor I binding and monocyte triggering activities," Eur. J. Immunol. 29:2613-2624.

Atkins, J.F. et al. (2007). "A case for "StopGo": Reprogramming translation to augment codon meaning of GGN by promoting unconventional termination (Stop) after addition of glycine and then allowing continued translation (Go)," RNA 13:803-810.

Balint, R.F. et al. (1993). "Antibody engineering by parsimonious mutagenesis," Gene 137:109-118.

Barbas, C.F. et al. (1994). "In vitro evolution of a neutralizing human antibody to human immunodeficiency virus type 1 to enhance affinity and broaden strain cross-reactivity," PNAS 91:3809-3813.

Berger, C. et al. (2015). "Safety of targeting ROR1 in primates with chimeric antigen receptor-modified T cells," Cancer Immunol. Res. 3:206-216.

Bierer, B.E. et al. (1993). "Cyclosporin A and FK506: molecular mechanisms of immunosuppression and probes for transplantation biology," Current Opin. Immunol. 5:763-773.

Bird, R.E. et al. (1988). "Single-chain antigen-binding proteins," Science 242:423-426.

Bloom, J.W. et al. (1997). "Intrachain disulfide bond in the core hinge region of human IgG4," Protein Science 6:407-415.

Boerner, P. et al. (1991). "Production of antigen-specific human monoclonal antibodies from in vitro-primed human splenocytes," J. Immunol. 147:86-95.

Boursalian, T.E. et al. (2009). "Chapter 7: Targeting CD70 for human therapeutic use," Adv. Exp. Med. Biol. 647:108-119.

Boyd, P.N. et al. (1996). "The Effect of the Removal of Sialic Acid, Galactose and Total Carbohydrate on the Functional Activity of Campath-1H," Mol. Immunol. 32:1311-1318.

(56) References Cited

OTHER PUBLICATIONS

Brenner, M.K. et al. (2010). "Adoptive T cell therapy of cancer," Curr. Opin. Immunol. 22:251-257.
Brown, B.A. et al. (1987). "Tumor-specific genetically engineered murine/human chimeric monoclonal antibody," Cancer Res. 47:3577-3583.
Buck, D.W. et al. (1982). "Monoclonal Antibodies Specific for Cell Culture Mycoplasmas," In Vitro 18:377-381.
Campana, D. et al. (2014). "4-1BB chimeric antigen receptors," Cancer J. 20:134-140.
Capel, P.J.A. et al. (1994). "Heterogeneity of human IgG Fc receptors," Immunomethods 4:25-34.
Chothia, C. et al. (1989). "Conformations of immunoglobulin hypervariable regions," Nature 342:877-883.
Clackson, T. et al. (1991). "Making antibody fragments using phage display libraries," Nature 352:624-628.
Clynes, R. et al. (1998). "Fc receptors are required in passive and active immunity to melanoma," PNAS 95:652-656.
Cole, S.P.C. et al. (1985). "The EBV-hybridoma technique and its application to human lung cancer," in Monoclonal Antibodies and Cancer Therapy, Proceedings of the Roche-UCLA Symposium Held in.
Connelly, S. et al. (1995). "In vivo gene delivery and expression of physiological levels of functional human factor VIII in mice," Human Gene Therapy 1:185-193.
Courtois, A. et al. (2012). "Complement dependent cytotoxicity activity of therapeutic antibody fragments is acquired by immunogenic glycan coupling," Electronic Journal of Biotechnology, pp. 1-11.
Curiel, D.T. et al. (1992). "High-efficiency gene transfer mediated by adenovirus coupled to DNA-polylysine complexes," Hum. Gene Ther. 3:147-154.
Daugherty, B.L. et al. (1991). "Polymerase chain reaction facilitates the cloning, CDR-grafting, and rapid expression of a murine monoclonal antibody directed against the CD18 component of leukocyte integrins," Nucl. Acids Res. 19:2471-2476.
Dayhoff, M.O. et al. (1978). "Chapter 22: A model of evolutionary change in proteins," in Atlas of Protein Sequence and Structure, National Biomedical Research Foundation, A model of evolutionary change in proteins—Matrices for detecting distant relationships, Washington DC vol. 5, Suppl. 3, pp. 345-358.
De Haas, M. et al. (1995). "Fcγ receptors of phagocytes," J. Lab. Clin. Med. 126:330-341.
Donnelly, M. et al. (2001). "Fluorescent Tagging of Herpes Simplex Virus Tegument Protein VP13/14 in Virus Infection," J. Virology 75:2575-2583.
Donnelly, M. et al. (2001). "Nuclear Localization and Shuttling of Herpes Simplex Virus Tegument Protein VP13/14," J. Virology 75:2566-2574.
Doronina, V.A. et al. (2008). "Site-Specific Release of Nascent Chains from Ribosomes at a Sense Codon," Mol. Cell. Biol. 28:4227-4239.
Eshhar, Z. et al. (1993). "Immunology Specific activation and targeting of cytotoxic lymphocytes through chimeric single chains consisting of antibody-binding domains and the γ or ζ subunits of the immunoglobulin and T-cell receptors," PNAS 90:720-724.
Fellouse, F.A. et al. (2007). "High-throughput Generation of Synthetic Antibodies from Highly Functional Minimalist Phage-displayed Libraries," J. Mol. Biol. 373:924-940.
Findeis, M.A. et al. (1993). "Targeted delivery of DNA for gene therapy via receptor," Trends Biotechnol. 11:202-205.
Gazzano-Santoro, H. et al. (1997). "A non-radioactive complement-dependent cytotoxicity assay for anti-CD20 monoclonal antibody," J. Immunol. Methods 202:163-171.
Ge, H. et al. (2017). "Tumor associated CD70 expression is involved in promoting tumor migration and macrophage infiltration in GBM," International Journal of Cancer 141:1434-1444.
GenBank accession No. P32970-1, CD70 antigen, 11 total pages.
GenBank accession No. AAA53133, 4-1BB (*Homo sapiens*), 2 total pages.

GenBank accession No. NP_0061 30.1, T-cell specific surface glycoprotein CD28 isoform 1 precursor (*Homo sapiens*), 4 total pages.
GenBank accession No. NP_001139345.1, T-cell surface glycoprotein CD8 alpha chain isoform 1 precursor (*Homo sapiens*), 3 total pages.
GenBank accession No. NM-005018.3, *Homo sapiens* programmed cell death 1 (PDCD1), mRNA, 5 total pages.
GenBank accession No. AF414120.1, *Homo sapiens* CTLA4 (CTLA4) mRNA, complete cds, 2 total pages.
GenBank accession No. NM-002286.5, *Homo sapiens* lymphocyte activating 3 (LAG3), mRNA, 4 total pages.
GenBank accession No. JX049979.1, *Homo sapiens* T-cell immunoglobulin and mucin domain-containing protein 3 mRNA, complete cds, 2 total pages.
GenBank accession No. NM-181780.3, *Homo sapiens* B and T lymphocyte associated (BTLA), transcript variant 1, mRNA, 5 total pages.
GenBank accession No. CR541888.1, *Homo sapiens* full open reading frame cDNA clone RZPDo834D0633D for gene CD160, CD160 antigen; complete cds, without stopcodon, 2 total pages.
GenBank accession No. NM-173799.4, *Homo sapiens* T cell immunoreceptor with Ig and ITIM domains (TIGIT), mRNA, 5 total pages.
GenBank accession No. NM-022153.1, *Homo sapiens* V-set immunoregulatory receptor (VSIR), mRNA, 5 total pages.
GenBank accession No. CR542051.1, *Homo sapiens* full open reading frame cDNA clone RZPDo834C0736D for gene LAIR1, leukocyte-associated Ig-like receptor 1; complete cds, without stopcodon, 2 total pages.
GenBank accession No. AY358337.1, *Homo sapiens* clone DNA54002 SIGLEC10 (UNQ477) mRNA, complete cds, 2 total pages.
GenBank accession No. NM-001166664.1, *Homo sapiens* CD244 molecule (CD244), transcript variant 3, mRNA, 4 total pages.
Grewal, I.S. et al. (2008). "CD70 as a therapeutic target in human malignancies," Expert Opinion on Therapeutic Targets 12:341-351.
Griffith, A.D. et al. (1993). "Human anti-self antibodies with high specificity from phage display libraries," EMBO J. 12:725-734.
Guyer, R.L. et al. (1976). "Immunoglobulin binding by mouse intestinal epithelial cell receptors," J. Immunol. 117:587-593.
Harlow, E. et al. (1999). Chapter 11: Epitope mapping in Using Antibodies, a Laboratory Manual, Cold Spring Harbor Laboratory Press, Cold Spring Harbor, New York, pp. 379-405.
Hawkins, R.E. et al. (1992). "Selection of Phage Antibodies by Binding Affinity Mimicking Affinity Maturation," J. Mal. Biol. 226:889-896.
Hein, J. (1990). "Unified Approach to Alignment and Phylogenes," Methods in Enzymology 183: 626-645.
Henderson, D.J. et al. (1991). "Comparison of the effects of FK-506, cyclosporin A and rapamycin on IL-2 production," Immunol. 73:316-321.
Higgins, D.G. et al. (1989). "Fast and sensitive multiple sequence alignments on a microcomputer," CABIOS 5:151-153.
Hoogenboom, H.R. et al. (1991). "By-passing Immunisation Human Antibodies from Synthetic Repertoires of Germline $V_H$ Gene Segments Rearranged in Vitro," J. Mol. Biol. 227:381-388.
Hsu, T-A. et al. (1997). "Differential N-Glycan Patterns of Secreted and Intracellular IgG Produced in Trichoplusia ni Cells," J. Biol. Chem. 272:9062-9070.
Humphreys, D.P. et al. (1997). "Formation of dimeric Fabs in *Escherichia coli*: effect of hinge size and isotype, presence of interchain disulphide bond, Fab' expression levels, tail piece sequences and growth conditions," J. Immunol. Methods 209:193-202.
International Search Report dated May 28, 2019, for PCT Application No. PCT/US2019/016189, filed on Jan. 31, 2019, 9 pages.
International Search Report dated May 13, 2019, for PCT Application No. PCT/US2019/016139, filed on Jan. 31, 2019, 14 pages.
Jackson, J.R. et al. (1995). "In vitro antibody maturation—Improvement of a high affinity, neutralizing antibody against IL-1β," J. Immunol. 154:3310-3319.
Jayasena, S.D. (1999). "Aptamers: An Emerging Class of Molecules That Rival Antibodies in Diagnostics," Clin. Chem. 45:1628-1650.

(56) References Cited

OTHER PUBLICATIONS

Jefferis, R. et al. (1997). "Glycosylation of antibody molecules: Structural and functional significance,"Chem. Immunol. Basel. Karger 65:111-128.
Jin, L. et al. (2017). "CD70, a novel target of CAR T-cell therapy for gliomas," Neuro-Oncology 20:55-65.
Johnson, K.S. et al. (1993). "Human antibody engineering," Current Opinion in Structural Biol. 3:564-571.
Jolly, D. (1994). "Viral vector systems for gene therapy," Cancer Gene Therapy 1:51-64.
Jones, P.T. et al. (1986). "Replacing the complementarity—Determining regions in a human antibody with those from a mouse," Nature 321:522-525.
Kaplitt, M.G. et al. (1994). "Long-term gene expression and phenotypic correction using adeno-associated virus vectors in the mammalian brain," Nature Genetics 6:148-154.
Kim et al. "Localization of the site of the murine IgG1 molecule that is involved in binding to the murine intestinal Fc receptor," J. Immunol. 24:2429-2434.
Kimura, O. et al. (1994). "Retroviral delivery of DNA into the livers of transgenic mice bearing premalignant and malignant hepatocellular carcinomas," Human Gene Therapy 5:845-852.
Kohler, C. et al. (1975). "Continuous cultures of fused cells secreting antibody of predefined specificity," Nature 256:495-497.
Liu, J. et al. (1992). "Inhibition of T Cell Signaling by Immunophilin-Ligand Complexes Correlates with Loss of Calcineurin Phosphatase Activity," Biochem. 31:3896-3901.
LoBuglio, A.F. et al. (1989). "Mouse/human chimeric monoclonal antibody in man: Kinetics and immune response," PNAS 86:4220-4224.
Lonberg, N. et al. (1995). "Human antibodies from transgenic mice," Intern. Rev. Immunol 13:65-93.
Maccallum, R.M. et al. (1996). "Antibody-antigen Interactions: Contact Analysis and Binding Site Topography," J. Mol. Biol. 262:732-745.
Makabe, K. et al. (2008). "Thermodynamic Consequences of Mutations in Vernier Zone Residues of a Humanized Anti-human Epidermal Growth," Journal of Biological Chemistry 283:1156-1166.
Marks, J.D. et al. (1991). "By-passing Immunization Human Antibodies from V-gene Libraries Displayed on Phage," J. Mol. Biol. 222:581-597.
Marks, J.D. et al. (1992). "By-passing immunization: Building high affinity human antibodies by chain shuffling," Bio/Technol. 10:779-783.
Martyniszyn, A. et al. (2017). "CD20-CD19 Bispecific CAR T Cells for the Treatment of B-Cell Malignancies," Human Gene Therapy 28:1147-1157.
McCafferty, J. et al. (1990). "Phage antibodies: filamentous phage displaying antibody variable domains," Nature 348:552-554.
McEarchern J.A. et al. (2007). "Engineered anti-CD70 antibody with multiple effector functions exhibits in vitro and in vivo antitumor activities," Blood 109:1185-1192.
Millstein, C. et al. (1983). "Hybrid hybridomas and their use in immunohistochemistry," Nature 305:537-539.
Morrison, S.L. et al. (1984). "Chimeric human antibody molecules: Mouse antigen-binding domains with human constant region domains," PNAS 81:6851-6855.
Myers, E.W. et al. (1988). "Optimal alignments in linear space," CABIOS 4:11-17.
Myszka, D.G. (1999). "Improving biosensor analysis," J Mol. Recognit. 12:279-284.
Niculescu-Duvaz, I. et al. (1997). "Antibody-directed enzyme prodrug therapy (ADEPT): a review," Adv. Drug Del. Rev. 26:151-172.
Payne, G. (2003). "Progress in immunoconjugate cancer therapeutics," Cancer Cell 3:207-212.
Peeters, K. et al. (2001). "Production of antibodies and antibody fragments in plants," Vaccine 19:2756-2761.
Philip, R. et al. (1994). "Efficient and Sustained Gene Expression in Primary T Lymphocytes and Primary and Cultured Tumor Cells Mediated by Adena-Associated Virus Plasmid DNA Complexed to Cationic Liposomes," Mol. Cell Biol. 14:2411-2418.
Pollock, D.P. et al. (1999). "Transgenic milk as a method for the production of recombinant antibodies," J Immunol Methods 231:147-157.
Ravetch, J.V. et al. (1991). "Fc receptors," Kinet, Ann. Rev. Immunol. 9:457-492.
Riechmann, L. et al. (1988). "Reshaping human antibodies for therapy," Nature 332:323-327.
Robinson, D.F. (1971). "Comparison of Labeled Trees with Valency Three," J. Comb. Theory 11:105-119.
Rosenberg, S.A. et al. (2008). "Adoptive cell transfer: a clinical path to effective cancer Immunotherapy," Nature Reviews Cancer 8:299-308.
Sadelain, M. et al. (2009). "The promise and potential pitfalls of chimeric antigen receptors," Curr. Opin. Immunol, 21:215-223.
Sadelain, M. et al. (2013). "The Basic Principles of Chimeric Antigen Receptor Design," Cancer Discovery 3:388-398.
Saitou, N. et al. (1987). "The neighbor-joining method: A new method for reconstructing phylogenetic trees," Mol. Biol. Evol. 4:406-425.
Schier, R. et al. (1995). "Identification of functional and structural amino-acid residues by parsimonious mutagenesis," Gene 169:147-155.
Shaffer, D.R. et al. (2011). "T cells redirected against CD70 for the immunotherapy of CD70-positive malignancies," Blood 117:4304-4314.
Shaw, D.R. et al. (1987). "Characterization of a mouse/human chimeric monoclonal antibody (17-1A) to a colon cancer tumor-associated antigen," J Immunol. 138:4534-4538.
Sheets, M.D. et al. (1998). "Efficient construction of a large nonimmune phage antibody library: The production of high-affinity human single-chain antibodies to protein antigens," PNAS 95:6157-6162.
Simmons, J.K. et al. (2015). "Animal Models of Bone Metastasis," Veterinary Pathology 52:827-841.
Suresh, M.R. et al. (1986). "Biospecific monoclonal antibodies from hybrid hybridomas," Methods in Enzymology 121:210-228.
Syrigos, K.N. et al. (1999). "Antibody Directed Enzyme Prodrug Therapy (ADEPT): A Review of the Experimental and Clinical Considerations," Anticancer Research 19:605-614.
Tiller, T. et al. (2008). "Efficient generation of monoclonal antibodies from single human B cells by single cell RT-PCR and expression vector cloning," J. Immunol. Methods 329:112-124.
Trail, P.A. et al. (2003). "Monoclonal antibody drug immunoconjugates for targeted treatment of cancer," Cancer Immunol. Immunother. 52:328-337.
Umana, P. et al. (1999). "Engineered glycoforms of an antineuroblastoma IgG1 with optimized antibody-dependent cellular cytotoxic activity," Mature Biotech. 17:176-180.
Vaughan, T.J. et al. (1996). "Human Antibodies with Sub-nanomolar Affinities Isolated from a Large Non-immunized Phage Display Library," Nature Biotechnol. 14:309-314.
Verhoeyen, M. et al. (1988). "Reshaping human antibodies: Grafting an antilysozyme activity," Science 239:1534-1536.
Wang, Q.J. et al. (2017). "Preclinical Evaluation of Chimeric Antigen Receptors Targeting CD70-Expressing Cancers," Clinical Cancer Research 23:2267-2276.
Ward, E.S. et al. (1989). "Binding activities of a repertoire of single immunoglobulin variable domains secreted from *Escherichia coli*," Nature 341:544-546.
Waterhouse, P. et al. (1993). "Combinatorial infection and in vivo recombination: a strategy for making large phage antibody repertoires," Nucl. Acids Res. 21:2265-2266.
Whitlow, M. et al. (1993). "An improved linker for single-chain Fv with reduced aggregation and enhanced proteolytic stability," Protein Eng. 6:989-995.
Wilbur, W.J. et al. (1983). "Rapid similarity searches of nucleic acid and protein data banks," PNAS 80:726-730.
Winter, G. et al. (1991). "Man-made antibodies," Nature 349:293-299.
Winter, G. et al. (1994). "Making Antibodies by Phage Display Technology," Annu. Rev. Immunol. 12:433-455.

(56) References Cited

OTHER PUBLICATIONS

Wittwer, A.J. et al. (1990). "Glycosylation at Asn-184 Inhibits the Conversion of Single-Chain to Two-Chain Tissue-Type Plasminogen Activator by Plasmin," Biochem. 29:4175-4180.

Woffendin, C. et al. (1994). "Nonviral and viral delivery of a human immunodeficiency virus protective gene into primary human T cells," PNAS 91:11581-11585.

Wright, A. et al. (1997). "Effect of glycosylation on antibody function: implications for genetic engineering," Tibtech 15:26-32.

Written Opinion of the International Searching Authority dated May 28, 2019, for PCT Application No. PCT/US2019/016189, filed on Jan. 31, 2019, 11 pages.

Written Opinion of the International Searching Authority dated May 13, 2019, for PCT Application No. PCT/US2019/016139, filed on Jan. 31, 2019, 14 pages.

Wu, G.Y. et al. (1988). "Receptor-mediated Gene Delivery and Expression in Vivo," J. Biol. Chem. 263:14621-14624.

Wu, C.H. et al. (1989). "Targeting Genes: Delivery and Persistent Expression of a Foreign Gene Driven by Mammalian Regulatory Elements in Vivo," J. Biol. Chem. 264:16985-16987.

Wu, G.Y. et al. (1991). "Receptor-mediated gene delivery in Vivo," J. Biol. Chem. 266:14338-14342.

Wu, G.Y. et al. (1994). "Incorporation of Adenovirus into a Ligand-based DNA Carrier System Results in Retention of Original Receptor Specificity and Enhances Targeted Gene Expression," J. Biol. Chem. 269:11542-11546.

Wyss, D.F. et al. (1996). "The structural role of sugars in glycoproteins," Current Opin. Biotech. 7:409-416.

Yelton, D.E. et al. (1995). "Affinity maturation of the BR96 anti-carcinoma antibody by codon-based mutagenesis," J. Immunol. 155:1994-2004.

Zarrabi, K. et al. (2017). "New treatment options for metastatic renal cell carcinoma with prior antiangiogenesis therapy," Journal of Hematology and Oncology 10:38, 12 total pages.

Zenke, M. et al. (1990). "Receptor-mediated endocytosis of transferrin-polycation conjugates: An efficient way to introduce DNA into hematopoietic cells," PNAS 87:3655-3659.

SG Written Opinion for SG Application No. 112020068830, dated Apr. 15, 2022, 12 pgs.

SG Search Report for SG Application No. 11202006883Q, dated Apr. 15, 2022, 5 pgs.

Hartmann et al., "Clinical development of CAR T cells-challenges and opportunities in translating innovative treatment concepts," EMBO Molecular Medicine, vol. 9, No. 9, 2017, pp. 1183-1197.

Jacobs et al., Peer-reviewed author-version attached of "CD70: an emerging target in cancer immunotherapthy," Pharmacology and therapeutics—ISSN 0163-7258-155 (2015), 33 pgs.

Li et al., "Increasing the safety and efficacy of chimeric antigen receptor T cell therapy," Protein Cell 8(8):573-589, 2017, DOI 10.1007/s13238-017-0411-9.

\* cited by examiner

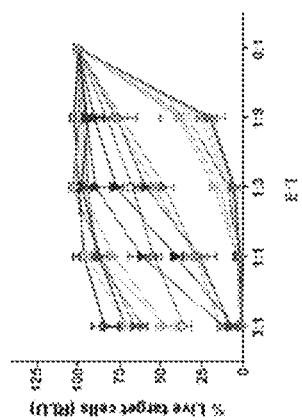
FIG. 8A
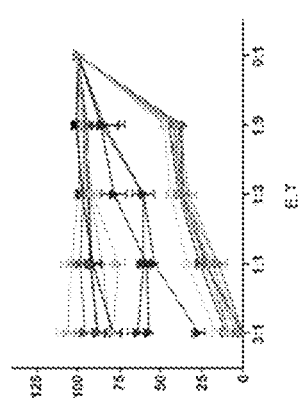
FIG. 8B
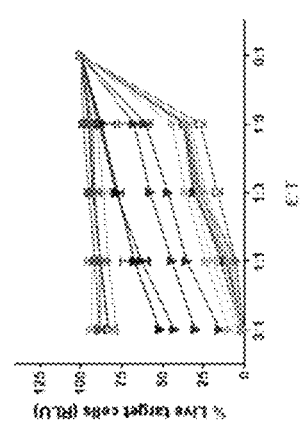
FIG. 8C
FIG. 8D

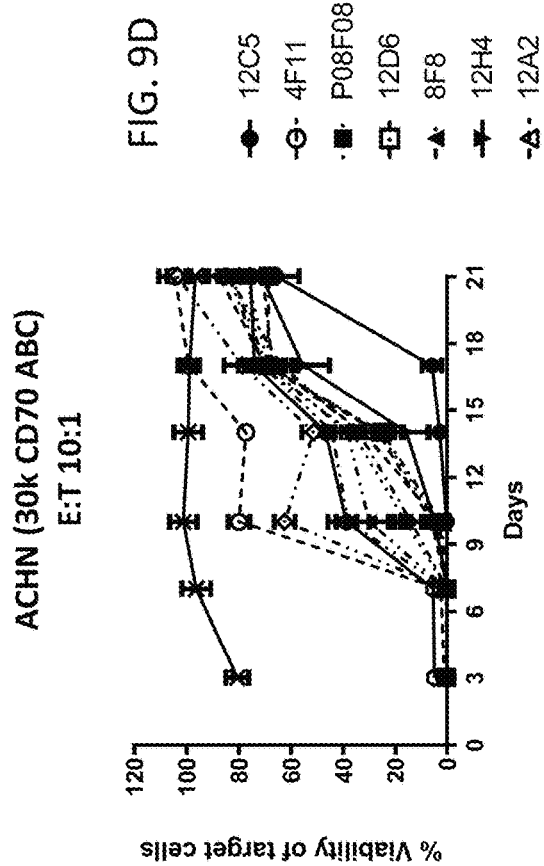
FIG. 9A
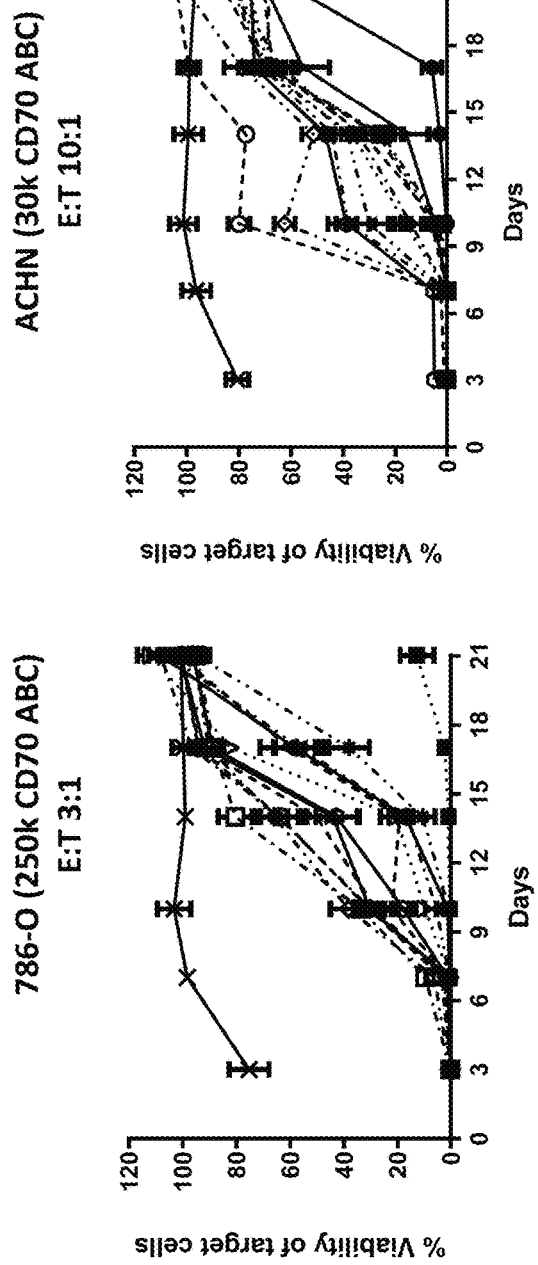
FIG. 9B
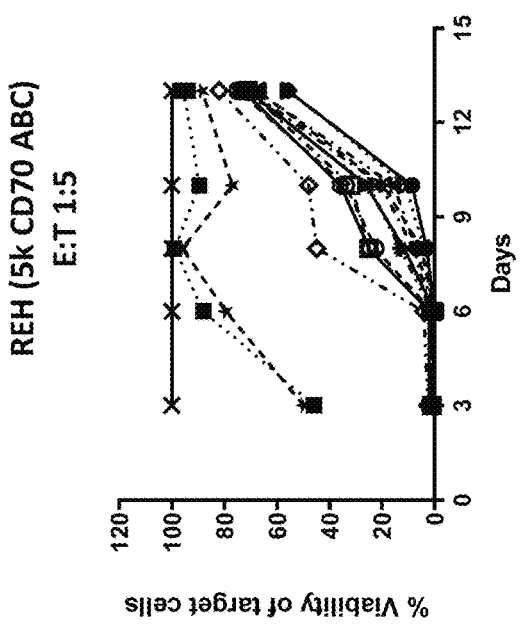
FIG. 9C
FIG. 9D

CHIMERIC ANTIGEN RECEPTORS TARGETING CD70

CROSS-REFERENCE TO RELATED APPLICATIONS

This application claims priority to U.S. Provisional Patent Appl. No. 62/775,246, filed Dec. 4, 2018, U.S. Provisional Patent Appl. No. 62/641,869, filed Mar. 12, 2018, U.S. Provisional Patent Appl. No. 62/641,873, filed Mar. 12, 2018, U.S. Provisional Patent Appl. No. 62/625,009, filed Feb. 1, 2018, and U.S. Provisional Patent Appl. No. 62/625,019, filed Feb. 1, 2018, each of which is incorporated herein by reference in its entirety.

REFERENCE TO SEQUENCE LISTING

This application is being filed electronically via EFS-Web and includes an electronically submitted sequence listing in .txt format. The .txt file contains a sequence listing entitled "ALGN_014_03US_SeqList_ST25.txt" created on Jan. 30, 2019 and having a size of ~725 kilobytes. The sequence listing contained in this .txt file is part of the specification and is incorporated herein by reference in its entirety.

FIELD

The disclosure relates to chimeric antigen receptors (CAR). CARs are able to redirect immune cell specificity and reactivity toward a selected target exploiting the ligand-binding domain properties. In particular, the disclosure relates to CARs that specifically bind to Cluster of Differentiation 70 (CD70-specific CARs). The disclosure further relates to polynucleotides encoding CD70-specific CARs and isolated cells expressing CD70-specific CARs at their surface. The disclosure further relates to methods for engineering immune cells expressing CD70-specific CARs at their surface. The disclosure is particularly useful for the treatment of cancer such as lymphoma, leukemia, glioma or Renal Cell Carcinoma (RCC). The disclosure further relates to immune cells comprising the CD70-specific CARs (CD70-specific CAR-T cells), compositions comprising the CD70-specific CAR-T cells, and methods of using the CD70-specific CAR-T cells for treating conditions associated with malignant cells expressing CD70 (e.g., cancer).

BACKGROUND

Adoptive transfer of immune cells genetically modified to recognize malignancy-associated antigens is showing promise as a new approach to treating cancer (see, e.g., Brenner et al., Current Opinion in Immunology, 22(2): 251-257 (2010); Rosenberg et al., Nature Reviews Cancer, 8(4): 299-308 (2008)). T cells can be genetically modified to express chimeric antigen receptors (CARs), fusion proteins comprised of an antigen recognition moiety and T cell activation domains (see, e.g., Eshhar et al., Proc. Natl. Acad. Sci. USA, 90(2): 720-724 (1993), and Sadelain et al., Curr. Opin. Immunol, 21(2): 215-223 (2009)).

Cluster of Differentiation 70 (CD70, CD27LG or TNFSF7) is a member of the tumor necrosis factor (TNF) superfamily and the ligand for CD27, a TNF superfamily receptor. The transient interaction between CD27 and CD70 provides T cell costimulation complementary to that provided by CD28. CD70 is expressed on hematological cancers such as Non-Hodgkin's Lymphoma and Hodgkin's disease as well as on solid tumors such as Glioblastoma and Renal Cell Carcinoma; with its expression on ccRCC being nearly uniform (see e.g., Grewal I., et al., Expert Opinion on Therapeutic Targets, 12(3): 341-351 (2008)). Adoptive transfer of T cells genetically modified to recognize malignancy-associated antigens is showing promise as a new approach to treating cancer (see, e.g., Brenner et al., Current Opinion in Immunology, 22(2): 251-257 (2010); Rosenberg et al., Nature Reviews Cancer, 8(4): 299-308 (2008)). T cells can be genetically modified to express chimeric antigen receptors (CARs), which are fusion proteins comprised of an antigen recognition moiety and T cell activation domains (see, e.g., Eshhar et al., Proc. Natl. Acad. Sci. USA, 90(2): 720-724 (1993), and Sadelain et al., Current Opinion in Immunology, 21(2): 215-223 (2009)). Expression of CD70 on normal tissues is limited to activated T cells, B cells, NK cells, and dendritic cells. However, CD70 expression on activated T cells may pose a concern for production of CAR T cells due to potential target-driven T cell differentiation, exhaustion, and fratricide during the production process.

Renal Cell Carcinoma (RCC) is a cancer that originates in the renal cortex and accounts for about 90% of cancers in the kidney. Based on histology, RCC can be classified into several sub-types, of which Clear Cell Renal Cell Carcinoma (ccRCC) is the most common and leads to the most deaths. Each year, over 320,000 cases of RCC are reported worldwide leading to roughly 140,000 deaths. The incidence of RCC has risen steadily over the last 10 years and accounts for 2-3% of all adult malignancies. Patients with early stage localized tumors can opt for surgical resection; however, localized disease can undergo early hematogenous dissemination leading to metastasis. Sites of early metastases include lungs, lymph nodes, liver, bone, and brain; less commonly the adrenal glands, and the contralateral kidney. Patients with advanced disease face high morbidity rates with a 5-year median survival rate of 53% for stage III disease and only 8% for metastatic disease. Current first-line treatment options for advanced disease include small molecule Tyrosine Kinase Inhibitors (TKIs) such as sunitinib and pazopanib that target Vascular Endothelial Growth Factor (VEGF) receptor, monoclonal antibody targeting VEGF such as bevacizumab, mammalian target of Rapamycin (mTOR) inhibitor temsirolimus, as well as high dose IL-2. Although these VEGF-targeted therapies have improved over-all survival, long-term drug resistance leads to disease relapse and treatment for advanced disease still remains an unmet need (see, e.g., Zarrabi, K. et al., Journal of Hematology and Oncology, 10:38 (2017)).

Accordingly, there is a need for alternative treatments for cancer and in particular malignancies involving aberrant expression of CD70. Novel immunotherapies, such as CAR T therapy, have the potential to significantly improve the outcome for patients with cancer where CD70 is expressed, for example in mRCC. Accordingly, treatment to a cancer (such as, e.g., mRCC) using CD70-specific CARs and CD70-specific CAR-T cells would make a promising therapeutic agent. Provided herein are methods and compositions addressing this need.

SUMMARY

Chimeric antigen receptors (CARs) that bind to CD70 are provided herein, as well as methods of making and methods of using the same. Also provided herein are immune cells, e.g. T-cells comprising such CD70 CARs. It is demonstrated that certain CD70-specific CARs are effective when expressed in T cells to activate T cells upon contact with CD70. Advantageously, the CD70-specific CARs provided herein bind human CD70. Also advantageously, the CD70-specific CAR-T cells provided herein exhibit cytotoxic activity upon contact with CD70-expressing cells. Also provided herein are antibodies that bind to CD70, as well as methods of making and methods of using the same. CD70-specific antibodies provided herein bind human CD70.

In one aspect, the disclosure provides Cluster of Differentiation 70 (CD70) specific chimeric antigen receptor (CAR) comprising an extracellular ligand-binding domain, a first transmembrane domain, and an intracellular signaling domain, wherein the extracellular domain comprises a single chain FIT fragment (scFv) binding to the extracellular domain of CD70.

In some embodiments, the disclosure provides a CD70-specific CAR wherein the extracellular domain of a CAR provided herein comprises a scFv comprising a heavy chain variable (VH) region comprising three CDRs from the VH region comprising the sequence shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 357, 359, 361, 363, 365, 367, 369, 371, 373, 375, 377, 379 or 381; and a light chain variable (VL) region comprising three CDRs from the VL region shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 356, 358, 360, 362, 364, 366, 368, 370, 372, 374, 376, 378 or 380. In some embodiments, the VH region comprises the sequence shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 357, 359, 361, 363, 365, 367, 369, 371, 373, 375, 377, 379 or 381, or a variant thereof with one or several conservative amino acid substitutions in residues that are not within a CDR and/or the VL region comprises the amino acid sequence shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 356, 358, 360, 362, 364, 366, 368, 370, 372, 374, 376, 378 or 380 or a variant thereof with one or several amino acid substitutions in amino acids that are not within a CDR.

In some embodiments, the VH region comprises a VH CDR1 comprising the amino acid sequence shown in SEQ ID NO: 49, 50, or 51; a VH CDR2 comprising the amino acid sequence shown in SEQ ID NO: 52 or 53; and a VH CDR3 comprising the amino acid sequence shown in SEQ ID NO: 54; and the VL region comprises a VL CDR1 comprising the amino acid sequence shown in SEQ ID NO: 193; a VL CDR2 comprising the amino acid sequence shown in SEQ ID NO: 194; and a VL CDR3 comprising the amino acid sequence shown in SEQ ID NO: 195.

In some embodiments, the VH region comprises the amino acid sequence shown in SEQ ID NO: 2 and the VL region comprises the amino acid sequence shown in SEQ ID NO: 1.

In some embodiments, the VH region comprises a VH CDR1 comprising the amino acid sequence shown in SEQ ID NO: 55, 56, or 57; a VH CDR2 comprising the amino acid sequence shown in SEQ ID NO: 58 or 59; and a VH CDR3 comprising the amino acid sequence shown in SEQ ID NO: 60; and the VL region comprises a VL CDR1 comprising the amino acid sequence shown in SEQ ID NO: 196; a VL CDR2 comprising the amino acid sequence shown in SEQ ID NO: 197; and a VL CDR3 comprising the amino acid sequence shown in SEQ ID NO: 198.

In some embodiments, the VH region comprises the amino acid sequence shown in SEQ ID NO: 4 and the VL region comprises the amino acid sequence shown in SEQ ID NO: 3.

In some embodiments, the VH region comprises a VH CDR1 comprising the amino acid sequence shown in SEQ ID NO: 61, 62, or 63; a VH CDR2 comprising the amino acid sequence shown in SEQ ID NO: 64 or 65; and a VH CDR3 comprising the amino acid sequence shown in SEQ ID NO: 66; and the VL region comprises a VL CDR1 comprising the amino acid sequence shown in SEQ ID NO: 199; a VL CDR2 comprising the amino acid sequence shown in SEQ ID NO: 200; and a VL CDR3 comprising the amino acid sequence shown in SEQ ID NO: 201.

In some embodiments, the VH region comprises the amino acid sequence shown in SEQ ID NO: 6 and the VL region comprises the amino acid sequence shown in SEQ ID NO: 5.

In some embodiments, the VH region comprises a VH CDR1 comprising the amino acid sequence shown in SEQ ID NO: 67, 68, or 69; a VH CDR2 comprising the amino acid sequence shown in SEQ ID NO: 70 or 71; and a VH CDR3 comprising the amino acid sequence shown in SEQ ID NO: 72; and the VL region comprises a VL CDR1 comprising the amino acid sequence shown in SEQ ID NO: 202; a VL CDR2 comprising the amino acid sequence shown in SEQ ID NO: 203; and a VL CDR3 comprising the amino acid sequence shown in SEQ ID NO: 204.

In some embodiments, the VH region comprises the amino acid sequence shown in SEQ ID NO: 8 and the VL region comprises the amino acid sequence shown in SEQ ID NO: 7.

In some embodiments, the VH region comprises a VH CDR1 comprising the amino acid sequence shown in SEQ ID NO: 73, 74, or 75; a VH CDR2 comprising the amino acid sequence shown in SEQ ID NO: 76 or 77; and a VH CDR3 comprising the amino acid sequence shown in SEQ ID NO: 78; and the VL region comprises a VL CDR1 comprising the amino acid sequence shown in SEQ ID NO: 205; a VL CDR2 comprising the amino acid sequence shown in SEQ ID NO: 206; and a VL CDR3 comprising the amino acid sequence shown in SEQ ID NO: 207.

In some embodiments, the VH region comprises the amino acid sequence shown in SEQ ID NO: 10 and the VL region comprises the amino acid sequence shown in SEQ ID NO: 9

In some embodiments, the VH region comprises a VH CDR1 comprising the amino acid sequence shown in SEQ ID NO: 79, 80, or 81; a VH CDR2 comprising the amino acid sequence shown in SEQ ID NO: 82 or 83; and a VH CDR3 comprising the amino acid sequence shown in SEQ ID NO: 84; and the VL region comprises a VL CDR1 comprising the amino acid sequence shown in SEQ ID NO: 208; a VL CDR2 comprising the amino acid sequence shown in SEQ ID NO: 209; and a VL CDR3 comprising the amino acid sequence shown in SEQ ID NO: 210.

In some embodiments, the VH region comprises the amino acid sequence shown in SEQ ID NO: 12 and the VL region comprises the amino acid sequence shown in SEQ ID NO: 11.

In some embodiments, the VH region comprises a VH CDR1 comprising the amino acid sequence shown in SEQ ID NO: 85, 86, or 87; a VH CDR2 comprising the amino acid sequence shown in SEQ ID NO: 88 or 89; and a VH CDR3 comprising the amino acid sequence shown in SEQ ID NO: 90; and the VL region comprises a VL CDR1 comprising the amino acid sequence shown in SEQ ID NO:

211; a VL CDR2 comprising the amino acid sequence shown in SEQ ID NO: 212; and a VL CDR3 comprising the amino acid sequence shown in SEQ ID NO: 213. In some embodiments, the VH region comprises the amino acid sequence shown in SEQ ID NO: 14 and the VL region comprises the amino acid sequence shown in SEQ ID NO: 13.

In some embodiments, the VH region comprises a VH CDR1 comprising the amino acid sequence shown in SEQ ID NO: 91, 92, or 93; a VH CDR2 comprising the amino acid sequence shown in SEQ ID NO: 94 or 95; and a VH CDR3 comprising the amino acid sequence shown in SEQ ID NO: 96; and the VL region comprises a VL CDR1 comprising the amino acid sequence shown in SEQ ID NO: 214; a VL CDR2 comprising the amino acid sequence shown in SEQ ID NO: 215; and a VL CDR3 comprising the amino acid sequence shown in SEQ ID NO: 216.

In some embodiments, the VH region comprises the amino acid sequence shown in SEQ ID NO: 16 and the VL region comprises the amino acid sequence shown in SEQ ID NO: 15.

In some embodiments, the VH region comprises a VH CDR1 comprising the amino acid sequence shown in SEQ ID NO: 97, 98, or 99; a VH CDR2 comprising the amino acid sequence shown in SEQ ID NO: 100 or 101; and a VH CDR3 comprising the amino acid sequence shown in SEQ ID NO: 102; and the VL region comprises a VL CDR1 comprising the amino acid sequence shown in SEQ ID NO: 217; a VL CDR2 comprising the amino acid sequence shown in SEQ ID NO: 218; and a VL CDR3 comprising the amino acid sequence shown in SEQ ID NO: 219.

In some embodiments, the VH region comprises the amino acid sequence shown in SEQ ID NO: 18 and the VL region comprises the amino acid sequence shown in SEQ ID NO: 17.

In some embodiments, the VH region comprises a VH CDR1 comprising the amino acid sequence shown in SEQ ID NO: 103, 104, or 105; a VH CDR2 comprising the amino acid sequence shown in SEQ ID NO: 106 or 107; and a VH CDR3 comprising the amino acid sequence shown in SEQ ID NO: 108; and the VL region comprises a VL CDR1 comprising the amino acid sequence shown in SEQ ID NO: 220; a VL CDR2 comprising the amino acid sequence shown in SEQ ID NO: 221; and a VL CDR3 comprising the amino acid sequence shown in SEQ ID NO: 222.

In some embodiments, the VH region comprises the amino acid sequence shown in SEQ ID NO: 20 and the VL region comprises the amino acid sequence shown in SEQ ID NO: 19.

In some embodiments, the VH region comprises a VH CDR1 comprising the amino acid sequence shown in SEQ ID NO: 109, 110, or 111; a VH CDR2 comprising the amino acid sequence shown in SEQ ID NO: 112 or 113; and a VH CDR3 comprising the amino acid sequence shown in SEQ ID NO: 114; and the VL region comprises a VL CDR1 comprising the amino acid sequence shown in SEQ ID NO: 223; a VL CDR2 comprising the amino acid sequence shown in SEQ ID NO: 224; and a VL CDR3 comprising the amino acid sequence shown in SEQ ID NO: 225.

In some embodiments, the VH region comprises the amino acid sequence shown in SEQ ID NO: 22 and the VL region comprises the amino acid sequence shown in SEQ ID NO: 21.

In some embodiments, the VH region comprises a VH CDR1 comprising the amino acid sequence shown in SEQ ID NO: 115, 116, or 117; a VH CDR2 comprising the amino acid sequence shown in SEQ ID NO: 118 or 119; and a VH CDR3 comprising the amino acid sequence shown in SEQ ID NO: 120; and the VL region comprises a VL CDR1 comprising the amino acid sequence shown in SEQ ID NO: 226; a VL CDR2 comprising the amino acid sequence shown in SEQ ID NO: 227; and a VL CDR3 comprising the amino acid sequence shown in SEQ ID NO: 228.

In some embodiments, the VH region comprises the amino acid sequence shown in SEQ ID NO: 24 and the VL region comprises the amino acid sequence shown in SEQ ID NO: 23.

In some embodiments, the VH region comprises a VH CDR1 comprising the amino acid sequence shown in SEQ ID NO: 121, 122, or 123; a VH CDR2 comprising the amino acid sequence shown in SEQ ID NO: 124 or 125; and a VH CDR3 comprising the amino acid sequence shown in SEQ ID NO: 126; and the VL region comprises a VL CDR1 comprising the amino acid sequence shown in SEQ ID NO: 229; a VL CDR2 comprising the amino acid sequence shown in SEQ ID NO: 230; and a VL CDR3 comprising the amino acid sequence shown in SEQ ID NO: 231.

In some embodiments, the VH region comprises the amino acid sequence shown in SEQ ID NO: 26 and the VL region comprises the amino acid sequence shown in SEQ ID NO: 25.

In some embodiments, the VH region comprises a VH CDR1 comprising the amino acid sequence shown in SEQ ID NO: 127, 128, or 129; a VH CDR2 comprising the amino acid sequence shown in SEQ ID NO: 130 or 131; and a VH CDR3 comprising the amino acid sequence shown in SEQ ID NO: 132; and the VL region comprises a VL CDR1 comprising the amino acid sequence shown in SEQ ID NO: 232; a VL CDR2 comprising the amino acid sequence shown in SEQ ID NO: 233; and a VL CDR3 comprising the amino acid sequence shown in SEQ ID NO: 234.

In some embodiments, the VH region comprises the amino acid sequence shown in SEQ ID NO: 28 and the VL region comprises the amino acid sequence shown in SEQ ID NO: 27.

In some embodiments, the VH region comprises a VH CDR1 comprising the amino acid sequence shown in SEQ ID NO: 133, 134, or 135; a VH CDR2 comprising the amino acid sequence shown in SEQ ID NO: 136 or 137; and a VH CDR3 comprising the amino acid sequence shown in SEQ ID NO: 138; and the VL region comprises a VL CDR1 comprising the amino acid sequence shown in SEQ ID NO: 235; a VL CDR2 comprising the amino acid sequence shown in SEQ ID NO: 236; and a VL CDR3 comprising the amino acid sequence shown in SEQ ID NO: 237.

In some embodiments, the VH region comprises the amino acid sequence shown in SEQ ID NO: 30 and the VL region comprises the amino acid sequence shown in SEQ ID NO: 29.

In some embodiments, the VH region comprises a VH CDR1 comprising the amino acid sequence shown in SEQ ID NO: 139, 140, or 141; a VH CDR2 comprising the amino acid sequence shown in SEQ ID NO: 142 or 143; and a VH CDR3 comprising the amino acid sequence shown in SEQ ID NO: 144; and the VL region comprises a VL CDR1 comprising the amino acid sequence shown in SEQ ID NO: 238; a VL CDR2 comprising the amino acid sequence shown in SEQ ID NO: 239; and a VL CDR3 comprising the amino acid sequence shown in SEQ ID NO: 240.

In some embodiments, the VH region comprises the amino acid sequence shown in SEQ ID NO: 32 and the VL region comprises the amino acid sequence shown in SEQ ID NO: 31.

In some embodiments, the VH region comprises a VH CDR1 comprising the amino acid sequence shown in SEQ ID NO: 145, 146, or 147; a VH CDR2 comprising the amino acid sequence shown in SEQ ID NO: 148 or 149; and a VH CDR3 comprising the amino acid sequence shown in SEQ ID NO: 150; and the VL region comprises a VL CDR1 comprising the amino acid sequence shown in SEQ ID NO: 241; a VL CDR2 comprising the amino acid sequence shown in SEQ ID NO: 242; and a VL CDR3 comprising the amino acid sequence shown in SEQ ID NO: 243.

In some embodiments, the VH region comprises the amino acid sequence shown in SEQ ID NO: 34 and the VL region comprises the amino acid sequence shown in SEQ ID NO: 33.

In some embodiments, the VH region comprises a VH CDR1 comprising the amino acid sequence shown in SEQ ID NO: 151, 152, or 153; a VH CDR2 comprising the amino acid sequence shown in SEQ ID NO: 154 or 155; and a VH CDR3 comprising the amino acid sequence shown in SEQ ID NO: 156; and the VL region comprises a VL CDR1 comprising the amino acid sequence shown in SEQ ID NO: 244; a VL CDR2 comprising the amino acid sequence shown in SEQ ID NO: 245; and a VL CDR3 comprising the amino acid sequence shown in SEQ ID NO: 246.

In some embodiments, the VH region comprises the amino acid sequence shown in SEQ ID NO: 36 and the VL region comprises the amino acid sequence shown in SEQ ID NO: 35.

In some embodiments, the VH region comprises a VH CDR1 comprising the amino acid sequence shown in SEQ ID NO: 157, 158, or 159; a VH CDR2 comprising the amino acid sequence shown in SEQ ID NO: 160 or 161; and a VH CDR3 comprising the amino acid sequence shown in SEQ ID NO: 162; and the VL region comprises a VL CDR1 comprising the amino acid sequence shown in SEQ ID NO: 247; a VL CDR2 comprising the amino acid sequence shown in SEQ ID NO: 248; and a VL CDR3 comprising the amino acid sequence shown in SEQ ID NO: 249.

In some embodiments, the VH region comprises the amino acid sequence shown in SEQ ID NO: 38 and the VL region comprises the amino acid sequence shown in SEQ ID NO: 37.

In some embodiments, the VH region comprises a VH CDR1 comprising the amino acid sequence shown in SEQ ID NO: 163, 164, or 165; a VH CDR2 comprising the amino acid sequence shown in SEQ ID NO: 166 or 167; and a VH CDR3 comprising the amino acid sequence shown in SEQ ID NO: 168; and the VL region comprises a VL CDR1 comprising the amino acid sequence shown in SEQ ID NO: 250; a VL CDR2 comprising the amino acid sequence shown in SEQ ID NO: 251; and a VL CDR3 comprising the amino acid sequence shown in SEQ ID NO: 252.

In some embodiments, the VH region comprises the amino acid sequence shown in SEQ ID NO: 40 and the VL region comprises the amino acid sequence shown in SEQ ID NO: 39.

In some embodiments, the VH region comprises a VH CDR1 comprising the amino acid sequence shown in SEQ ID NO: 169, 170, or 171; a VH CDR2 comprising the amino acid sequence shown in SEQ ID NO: 172 or 173; and a VH CDR3 comprising the amino acid sequence shown in SEQ ID NO: 174; and the VL region comprises a VL CDR1 comprising the amino acid sequence shown in SEQ ID NO: 253; a VL CDR2 comprising the amino acid sequence shown in SEQ ID NO: 254; and a VL CDR3 comprising the amino acid sequence shown in SEQ ID NO: 255.

In some embodiments, the VH region comprises the amino acid sequence shown in SEQ ID NO: 42 and the VL region comprises the amino acid sequence shown in SEQ ID NO: 41.

In some embodiments, the VH region comprises a VH CDR1 comprising the amino acid sequence shown in SEQ ID NO: 175, 176, or 177; a VH CDR2 comprising the amino acid sequence shown in SEQ ID NO: 178 or 179; and a VH CDR3 comprising the amino acid sequence shown in SEQ ID NO: 180; and the VL region comprises a VL CDR1 comprising the amino acid sequence shown in SEQ ID NO: 256; a VL CDR2 comprising the amino acid sequence shown in SEQ ID NO: 257; and a VL CDR3 comprising the amino acid sequence shown in SEQ ID NO: 258.

In some embodiments, the VH region comprises the amino acid sequence shown in SEQ ID NO: 44 and the VL region comprises the amino acid sequence shown in SEQ ID NO: 43.

In some embodiments, the VH region comprises a VH CDR1 comprising the amino acid sequence shown in SEQ ID NO: 181, 182, or 183; a VH CDR2 comprising the amino acid sequence shown in SEQ ID NO: 184 or 185; and a VH CDR3 comprising the amino acid sequence shown in SEQ ID NO: 186; and the VL region comprises a VL CDR1 comprising the amino acid sequence shown in SEQ ID NO: 259; a VL CDR2 comprising the amino acid sequence shown in SEQ ID NO: 260; and a VL CDR3 comprising the amino acid sequence shown in SEQ ID NO: 261.

In some embodiments, the VH region comprises the amino acid sequence shown in SEQ ID NO: 46 and the VL region comprises the amino acid sequence shown in SEQ ID NO: 45.

In some embodiments, the VH region comprises a VH CDR1 comprising the amino acid sequence shown in SEQ ID NO: 187, 188, or 189; a VH CDR2 comprising the amino acid sequence shown in SEQ ID NO: 190 or 191; and a VH CDR3 comprising the amino acid sequence shown in SEQ ID NO: 192; and the VL region comprises a VL CDR1 comprising the amino acid sequence shown in SEQ ID NO: 262; a VL CDR2 comprising the amino acid sequence shown in SEQ ID NO: 263; and a VL CDR3 comprising the amino acid sequence shown in SEQ ID NO: 264.

In some embodiments, the VH region comprises the amino acid sequence shown in SEQ ID NO: 48 and the VL region comprises the amino acid sequence shown in SEQ ID NO: 47.

In some embodiments, each CDR is defined in accordance with the Kabat definition, the Chothia definition, the combination of the Kabat definition and the Chothia definition, the AbM definition, or the contact definition of CDR.

In some embodiments, each CDR is defined in accordance with the Kabat definition, the Chothia definition, the extended definition, the combination of the Kabat definition and the Chothia definition, the AbM definition, the contact definition, and/or the conformational definition of CDRs.

In some embodiments, the intracellular signaling domain comprises a CD3 signalling domain. In some embodiments, the intracellular signaling domain comprises a 4-1BB domain. In some embodiments, the CAR further comprises a second intracellular signaling domain. In some embodiments, the second intracellular signaling domain comprises a 4-1BB domain. In some embodiments, the CAR comprises a first CD3ζ intracellular signaling domain and a second 4-1BB intracellular signaling domain.

In some embodiments, the intracellular signaling domain comprises a CD3 signalling domain. In some embodiments, the intracellular signaling domain comprises a 4-1BB domain. In some embodiments, the CAR further comprises two intracellular signaling domains. In some embodiments, the CAR further comprises 3, 4, 5, or 6 intracellular signaling domains. In some embodiments, the CAR comprises a first intracellular signaling domain and a second intracellular signaling domain, wherein the second intracellular signaling domain comprises a 4-1BB domain. In some embodiments, the CAR comprises an CD3ζ intracellular signaling domain and a 4-1BB intracellular signaling domain.

In some embodiments, the CAR can comprise a stalk domain between the extracellular ligand-binding domain and the first transmembrane domain. In some embodiments, the stalk domain is selected from the group consisting of: a human CD8α hinge, an IgG1 hinge, and an FcγRIIIα hinge. In some embodiments, the stalk domain is a human CD8α hinge, a human IgG1 hinge, or a human FcγRIIIα hinge.

In some embodiments, the CAR can comprise a CD20 epitope. In some embodiments, the CD20 epitope comprises the amino acid sequence shown in SEQ ID NO: 293 or SEQ ID NO: 294 or SEQ ID NO: 609.

In some embodiments, the CAR can comprise the amino acid sequence shown in SEQ ID NO: 311 to 334 listed in Table 5. In some embodiments, the CAR can comprise the amino acid sequence shown in SEQ ID NO: 319 or 327.

In some embodiments, the first transmembrane domain comprises a CD8α chain transmembrane domain.

In some embodiments, the CAR can comprise another extracellular ligand-binding domain which is not specific for CD70.

In some embodiments, the extracellular ligand-binding domain(s), the first transmembrane domain, and intracellular signaling domain(s) are on a single polypeptide.

In some embodiments, the CAR can comprise a second transmembrane domain, wherein the first transmembrane domain and the extracellular ligand-binding domain(s) are on a first polypeptide, and wherein the second transmembrane domain and the intracellular signaling domain(s) are on a second polypeptide, wherein the first transmembrane domain comprises a transmembrane domain from the α chain of the high-affinity IgE receptor (FcεRI) and the second transmembrane domain comprises a transmembrane domain from the γ or β chain of FcεRI.

In some embodiments, the CAR can comprise a third polypeptide comprising a third transmembrane domain fused to an intracellular signaling domain from a co-stimulatory molecule, wherein the third transmembrane domain comprises a transmembrane domain from the γ or β chain of FcεRI.

In another aspect, the disclosure provides an isolated polynucleotide comprising a nucleic acid sequence encoding the CD70-specific CAR described herein.

In another aspect, the disclosure provides an expression vector comprising the polynucleotide encoding the CD70-specific CAR described herein.

In another aspect, the disclosure provides an engineered immune cell expressing at its cell-surface membrane a CD70-specific CAR described herein. In some embodiments, the engineered immune cell can comprise another CAR which is not specific for CD70. In some embodiments, the engineered immune cell can comprise a polynucleotide encoding a suicide polypeptide. In some embodiments, the suicide polypeptide is RQR8.

In some embodiments, the engineered immune is derived from an inflammatory T-lymphocyte, a cytotoxic T-lymphocyte, a regulatory T-lymphocyte, or a helper T-lymphocyte.

In some embodiments, the engineered immune cell can comprise a disruption one or more endogenous genes, wherein the endogenous gene encodes TCRα, TCRβ, CD52, glucocorticoid receptor (GR), deoxycytidine kinase (dCK), CD70 or an immune checkpoint protein such as for example programmed death-1 (PD-1).

In some embodiments, the engineered immune cell is obtained from a healthy donor. In some embodiments, the engineered immune cell is obtained from a patient.

In another aspect, the disclosure provides an engineered immune cell expressing at its cell-surface membrane a CD70-specific CAR as described herein for use as a medicament. In some embodiments, the medicament is for use in treatment of a cancer. In some embodiments, the medicament is for treatment of Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

In another aspect, the disclosure provides a method of engineering an immune cell comprising: providing an immune cell; and expressing at the surface of the cell at least one CD70-specific CAR as described herein. In some embodiments, the method comprises: providing an immune cell; introducing into the cell at least one polynucleotide encoding said CD70-specific CAR; and expressing said polynucleotide into the cell.

In some embodiments, the method comprises providing an immune cell; introducing into the cell at least one polynucleotide encoding said CD70-specific CAR; and introducing at least one other CAR which is not specific for CD70.

In another aspect, the disclosure provides a method of treating a subject suffering from a condition associated with malignant cells, the method comprising: providing a immune cell expressing at the surface a CD70-specific CAR as described herein; and administering said immune cells to said patient.

In another aspect, the disclosure provides a pharmaceutical composition comprising an engineered immune cell as described herein.

In another aspect, the disclosure provides a method of treating a condition associated with malignant cells expressing CD70 in a subject comprising administering to a subject in need thereof an effective amount of the pharmaceutical composition comprising an engineered immune cell as described herein. In some embodiments, the condition is a cancer. In some embodiments, the cancer is a Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

In another aspect, the disclosure provides a method of inhibiting tumor growth or progression in a subject who has malignant cells expressing CD70, comprising administering to the subject in need thereof an effective amount of the pharmaceutical composition comprising an engineered immune cell as described herein to the subject.

In another aspect, the disclosure provides a method of inhibiting metastasis of malignant cells expressing CD70 in a subject, comprising administering to the subject in need thereof an effective amount of the pharmaceutical composition comprising an engineered immune cell as described herein to the subject.

In another aspect, the disclosure provides a method of inducing tumor regression in a subject who has malignant cells expressing CD70, comprising administering to the subject in need thereof an effective amount of the pharmaceutical composition comprising an engineered immune cell as described herein to the subject.

In some embodiments, any of the above methods further comprises administering one or more additional therapies, such as for example, a monoclonal antibody and/or a chemotherapeutic. In some embodiments, the monoclonal antibody can be, for example, an antibody that binds to a checkpoint inhibitor such as, for example, an anti-PD-1 antibody or an anti-PD-L1 antibody. In some embodiments, any of the above methods further comprises administering a Receptor Tyrosine Kinase inhibitor such as sunitinib or axitinib.

In some embodiments, the disclosure provides a CD70-specific CAR comprising an extracellular ligand-binding domain, a transmembrane domain, and an intracellular signaling domain, wherein the extracellular domain comprises a single chain Fv fragment (scFv) binding to the extracellular domain of CD70 having a heavy chain variable (VH) region and a light chain variable (VL) region; wherein the VH region comprises an amino acid sequence that shares at least 95%, 96%, 97%, 98%, 99%, to 100% with SEQ ID NO: 18 and the VL region comprises an amino acid sequence that shares at least 95%, 96%, 97%, 98%, 99%, to 100% with SEQ ID NO: 17; or the VH region comprises an amino acid sequence that shares at least 95%, 96%, 97%, 98%, 99%, to 100% with SEQ ID NO: 34 and the VL region comprises an amino acid sequence that shares at least 95%, 96%, 97%, 98%, 99%, to 100% with SEQ ID NO: 33.

In some embodiments, the extracellular domain comprises an amino acid sequence that shares at least 95%, 96%, 97%, 98%, 99%, to 100% with SEQ ID NO: 319. In some embodiments, the extracellular domain comprises an amino acid sequence that shares at least 95%, 96%, 97%, 98%, 99%, to 100% with SEQ ID NO: 327.

In some embodiments, the disclosure provides a polynucleotide encoding a CD70-specific CAR, wherein the polynucleotide comprises a nucleic-acid sequence that shares at least 95%, 96%, 97%, 98%, 99%, to 100% with SEQ ID NO: 297 and shares at least 95%, 96%, 97%, 98%, 99%, to 100% with SEQ ID NO: 298; or shares at least 95%, 96%, 97%, 98%, 99%, to 100% with SEQ ID NO: 307 and shares at least 95%, 96%, 97%, 98%, 99%, to 100% with SEQ ID NO: 308.

In some embodiments, the disclosure provides CAR comprising an antigen binding molecule that specifically binds to CD70, wherein the antigen binding molecule comprises at least one of: a variable heavy chain CDR1 comprising an amino acid sequence selected from the group consisting of SEQ ID NOs: 49-51, 55-57, 61-63, 67-69, 73-75, 79-81, 85-87, 91-93, 97-99, 103-105, 109-111, 115-117, 121-123, 127-129, 133-135, 139-141, 145-147, 151-153, 157-159, 163-165, 169-171, 175-177, 181-183, 187-189, 382-384, 388-390, 394-396, 400-402, 406-408, 412-414, 418-420, 424-426, 430-432, 436-438, 442-444, 448-450, 454-456, 460-462, 466-468, 472-474, 478-480, 484-486, 490-492, 496-498, 502-504, and 508-510; a variable heavy chain CDR2 comprising an amino acid sequence selected from the group consisting of SEQ NOs 52, 53, 58, 59, 64, 65, 70, 71, 76, 77, 82, 83, 88, 89, 94, 95, 100, 101, 106, 107, 112, 113, 118, 119, 124, 125, 130, 131, 136, 137, 142, 143, 148, 149, 154, 155, 160, 161, 166, 167, 172, 173, 178, 179, 184, 185, 190, 191, 385, 386, 391, 392, 397, 398, 403, 404, 409, 410, 415, 416, 421, 422, 427, 428, 433, 434, 439, 440, 445, 446, 451, 452, 457, 458, 463, 464, 469, 470, 475, 476, 481, 482, 487, 488, 493, 494, 499, 500, 505, 506, 511, and 512; a variable heavy chain CDR3 comprising an amino acid sequence selected from the group consisting of SEQ ID NOs 54, 60, 66, 72, 78, 84, 90, 96, 102, 108, 114, 120, 126, 132, 138, 144, 150, 156, 162, 168, 174, 180, 186, 192, 387, 393, 399, 405, 411, 417, 423, 429, 435, 441, 447, 453, 459, 465, 471, 477, 483, 489, 495, 501, 507, and 513; a variable light chain CDR1 comprising an amino acid sequence selected from the group consisting of SEQ NOs: 193, 196, 199, 202, 205, 208, 211, 214, 217, 220, 223, 226, 229, 232, 235, 238, 241, 244, 247, 250, 253, 256, 259, 262, 514, 517, 520, 523, 526, 529, 532, 535, 538, 541, 544, 547, 550, 553, 556, 559, 562, 565, 568, 571, 574, and 577; a variable light chain CDR2 comprising an amino acid sequence selected from the group consisting of SEQ ID NOs. 194, 197, 200, 203, 206, 209, 212, 215, 218, 221, 224, 227, 230, 233, 236, 239, 242, 245, 248, 251, 254, 257, 260, 263, 515, 518, 521, 524, 527, 530, 533, 536, 539, 542, 545, 548, 551, 554, 557, 560, 563, 566, 569, 572, 575, and 578; and a variable light chain CDR3 comprising an amino acid sequence selected from the group consisting of SEQ ID NOs. 195, 198, 201, 204, 207, 210, 213, 216, 219, 222, 225, 228, 231, 234, 237, 240, 243, 246, 249, 252, 255, 258, 261, 264, 516, 519, 522, 525, 528, 531, 534, 537, 540, 543, 546, 549, 552, 555, 558, 561, 564, 567, 570, 573, 576, and 579.

In some embodiments, the antigen binding molecule comprises a variable heavy chain domain comprising amino acid sequences for CDRH1, CDRH2, and CDRH3, respectively, selected from one of SEQ ID NOs: 49-51, 52-53, 54; 55-57, 58-59, 60; 61-63, 64-65, 66; 67-69, 70-71, 72; 73-75, 76-77, 78; 79-81, 82-83, 84; 85-87, 88-89, 90; 91-93, 94-95, 96; 97-99, 100-101, 102; 103-105, 106-107, 108; 109-111, 112-113, 114; 115-117, 118-119, 120; 121-123, 124-125, 126; 127-129, 130-131, 132; 133-135, 136-137, 138; 139-141, 142-143, 144; 145-147, 148-149, 150; 151-153, 154-155, 156; 157-159, 160-161, 162; 163-165, 166-167, 168; 169-171, 172-173, 174; 175-177, 178-179, 180; 181-183, 184-185, 186; 187-189, 190-191, 192; 382-384, 385-386, 387; 388-390, 391-392, 393; 394-396, 397-398, 399; 400-402, 403-404, 405; 406-408, 409-410, 411; 412-414, 415-416, 417; 418-420, 421-422, 423; 424-426, 427-428, 429; 430-432, 433-434, 435; 436-438, 439-440, 441; 442-444, 445-446, 447; 448-450, 451-452, 453; 454-456, 457-458, 459; 460-462, 463-464, 465; 466-468, 469-470, 471; 472-474, 475-476, 477; 478-480, 481-482, 483; 484-486, 487-488, 489; 490-492, 493-494, 495; 496-498, 499-500, 501; 502-504, 505-506, 507; or 508-510, 511-512, 513; and a variable light chain domain comprising amino acid sequences for CDRL1, CDRL2, and CDRL3, respectively, selected from one of SEQ ID NOs: 193, 194, 195; 196, 197, 198; 199, 200, 201; 202, 203, 204; 205, 206, 207; 208, 209, 210; 211, 212, 213; 214, 215, 216; 217, 218, 219; 220, 221, 222; 223, 224, 225; 226, 227, 228; 229, 230, 231; 232, 233, 234; 235, 236, 237; 238, 239, 240; 241, 242, 243; 244, 245, 246; 247, 248, 249; 250, 251, 252; 253, 254, 255; 256, 257, 258; 259, 260, 261; 262, 263, 264; 514, 515, 516; 517, 518, 519; 520, 521, 522; 523, 524, 525; 526, 527, 528; 529, 530, 531; 532, 533, 534; 535, 536, 537; 538, 539, 540; 541, 542, 543; 544, 545, 546; 547, 548, 549; 550, 551, 552; 553, 554, 555; 556, 557, 558; 559, 560, 561; 562, 563, 564; 565, 566, 567; 568, 569, 570; 571, 572, 573; 574, 575, 576; and 577, 578, 579.

In some embodiments, the antigen binding molecule comprises amino acid sequences for CDRH1, CDRH2, CDRH3, CDRL1, CDRL2, and CDRL3, respectively, selected from one of SEQ ID NOs 49-51, 52-53, 54, 193, 194, 195; 55-57, 58-59, 60, 196, 197, 198; 61-63, 64-65, 66, 199, 200, 201; 67-69, 70-71, 72, 202, 203, 204; 73-75, 76-77, 78, 205, 206, 207; 79-81, 82-83, 84, 208, 209, 210;

85-87, 88-89, 90, 211, 212, 213; 91-93, 94-95, 96, 214, 215, 216; 97-99, 100-101, 102, 217, 218, 219; 103-105, 106-107, 108, 220, 221, 222; 109-111, 112-113, 114, 223, 224, 225; 115-117, 118-119, 120, 226, 227, 228; 121-123, 124-125, 126, 229, 230, 231; 127-129, 130-131, 132, 232, 233, 234; 133-135, 136-137, 138, 235, 236, 237; 139-141, 142-143, 144, 238, 239, 240; 145-147, 148-149, 150, 241, 242, 243; 151-153, 154-155, 156, 244, 245, 246; 157-159, 160-161, 162, 247, 248, 249; 163-165, 166-167, 168, 250, 251, 252; 169-171, 172-173, 174, 253, 254, 255; 175-177, 178-179, 180, 256, 257, 258; 181-183, 184-185, 186, 259, 260, 261; 187-189, 190-191, 192, 262, 263, 264; 382-384, 385-386, 387, 514, 515, 516; 388-390, 391-392, 393, 517, 518, 519; 394-396, 397-398, 399, 520, 521, 522; 400-402, 403-404, 405, 523, 524, 525; 406-408, 409-410, 411, 526, 527, 528; 412-414, 415-416, 417, 529, 530, 531; 418-420, 421-422, 423, 532, 533, 534; 424-426, 427-428, 429, 535, 536, 537; 430-432, 433-434, 435, 538, 539, 540; 436-438, 439-440, 441, 541, 542, 543; 442-444, 445-446, 447, 544, 545, 546; 448-450, 451-452, 453, 547, 548, 549; 454-456, 457-458, 459, 550, 551, 552; 460-462, 463-464, 465, 553, 554, 555; 466-468, 469-470, 471, 556, 557, 558; 472-474, 475-476, 477, 559, 560, 561; 478-480, 481-482, 483, 562, 563, 564; 484-486, 487-488, 489, 565, 566, 567; 490-492, 493-494, 495, 568, 569, 570; 496-498, 499-500, 501, 571, 572, 573; 502-504, 505-506, 507, 574, 575, 576; and 508-510, 511-512, 513, 577, 578, 579.

In some embodiments, the antigen binding molecule comprises a variable light chain domain comprising an amino acid sequences for CDRH1, CDRH2, and CDRH3, respectively, selected from one of SEQ ID NOs: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 356, 358, 360, 362, 364, 366, 368, 370, 372, 374, 376, 378, and 380; and a variable heavy chain domain comprising amino acid sequences for CDRL1, CDRL2, and CDRH3, respectively, selected from one of SEQ ID NOs: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 357, 359, 361, 363, 365, 367, 369, 371, 373, 375, 377, 379, and 381.

In some embodiments, the antigen binding molecule comprises amino acid sequences for light chain variable domain and heavy chain variable domain, respectively, selected from one of SEQ ID NOs: 1 and 2; 3 and 4; 5 and 6; 7 and 8; 9 and 10; 11 and 12; 13 and 14; 15 and 16; 17 and 18; 19 and 20; 21 and 22; 23 and 24; 25 and 26; 27 and 28; 29 and 30; 31 and 32; 33 and 34; 35 and 36; 37 and 38; 39 and 40; 41 and 42; 43 and 44; 45 and 46; 47 and 48; 338 and 339; 340 and 341; 342 and 343; 344 and 345; 346 and 347; 348 and 349; 350 and 351; 352 and 353; 354 and 355; 356 and 357; 358 and 359; 360 and 361; 362 and 363; 364 and 365; 366 and 367; 368 and 369; 370 and 371; 372 and 373; 374 and 375; 376 and 377; 378 and 379; and 380 and 381.

In another aspect, the disclosure provides antibodies, which specifically bind to Cluster of Differentiation 70 (CD70).

In some embodiments, the antibody comprises a VH region shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 662, 357, 359, 361, 363, 365, 367, 369, 371, 373, 375, 377, 379, or 381; and/or a VL region shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 661, 356, 358, 360, 362, 364, 366, 368, 370, 372, 374, 376, 378, or 380.

In some embodiments, the antibody comprises a heavy chain variable (VH) region comprising (i) a VH CDR1 comprising the sequence shown in SEQ ID NO: 49, 50, 51, 55, 56, 57, 61, 62, 63, 67, 68, 69, 73, 74, 75, 79, 80, 81, 85, 86, 87, 91, 92, 93, 97, 98, 99, 103, 104, 105, 109, 110, 111, 115, 116, 117, 121, 122, 123, 127, 128, 129, 133, 134, 135, 139, 140, 141, 145, 146, 147, 151, 152, 153, 157, 158, 159, 163, 164, 165, 169, 170, 171, 175, 176, 177, 181, 182, 183, 187, 188, 189, 382, 383, 384, 388, 389, 390, 394, 395, 396, 400, 401, 402, 406, 407, 408, 412, 413, 414, 418, 419, 420, 424, 425, 426, 430, 431, 432, 663, 664, 665, 436, 437, 438, 442, 443, 444, 448, 449, 450, 454, 455, 456, 460, 461, 462, 466, 467, 468, 472, 473, 474, 478, 479, 480, 484, 485, 486, 490, 491, 492, 496, 497, 498, 502, 503, 504, 508, 509, or 510; (ii) a VH CDR2 comprising the sequence shown in SEQ ID NO: 52, 53, 58, 59, 64, 65, 70, 71, 76, 77, 82, 83, 88, 89, 94, 95, 100, 101, 106, 107, 112, 113, 118, 119, 124, 125, 130, 131, 136, 137, 142, 143, 148, 149, 154, 155, 160, 161, 166, 167, 172, 173, 178, 179, 184, 185, 190, 191, 385, 386, 391, 392, 397, 398, 403, 404, 409, 410, 415, 416, 421, 422, 427, 428, 433, 434, 666, 667, 439, 440, 445, 446, 451, 452, 457, 458, 463, 464, 469, 470, 475, 476, 481, 482, 487, 488, 493, 494, 499, 500, 505, 506, 511, or 512; and iii) a VH CDR3 comprising the sequence shown in SEQ ID NO: 54, 60, 66, 72, 78, 84, 90, 96, 102, 108, 114, 120, 126, 132, 138, 144, 150, 156, 162, 168, 174, 180, 186, 192, 387, 393, 399, 405, 411, 417, 423, 429, 435, 668, 441, 447, 453, 459, 465, 471, 477, 483, 489, 495, 501, 507, or 513; and/or a light chain variable (VL) region comprising (i) a VL CDR1 comprising the sequence shown in SEQ ID NO: 193, 196, 199, 202, 205, 208, 211, 214, 217, 220, 223, 226, 229, 232, 235, 238, 241, 244, 247, 250, 253, 256, 259, 262, 514, 517, 520, 523, 526, 529, 532, 535, 538, 669, 541, 544, 547, 550, 553, 556, 559, 562, 565, 568, 571, 574, or 577; (ii) a VL CDR2 comprising the sequence shown in SEQ ID NO: 194, 197, 200, 203, 206, 209, 212, 215, 218, 221, 224, 227, 230, 233, 236, 239, 242, 245, 248, 251, 254, 257, 260, 263, 515, 518, 521, 524, 527, 530, 533, 536, 539, 670, 542, 545, 548, 551, 554, 557, 560, 563, 566, 569, 572, 575, or 578; and (iii) a VL CDR3 comprising the sequence shown in SEQ ID NO: 195, 198, 201, 204, 207, 210, 213, 216, 219, 222, 225, 228, 231, 234, 237, 240, 243, 246, 249, 252, 255, 258, 261, 264, 516, 519, 522, 525, 528, 531, 534, 537, 540, 671, 543, 546, 549, 552, 555, 558, 561, 564, 567, 570, 573, 576, or 579.

In some embodiments, the antibody comprises a VH region comprising a VH CDR1, VH CDR2, and VH CDR3 of the VH sequence shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 662, 357, 359, 361, 363, 365, 367, 369, 371, 373, 375, 377, 379, or 381; and/or a VL region comprising VL CDR1, VL CDR2, and VL CDR3 of the VL sequence shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 661, 356, 358, 360, 362, 364, 366, 368, 370, 372, 374, 376, 378, or 380.

In yet further aspects, the disclosure provides nucleic acids, vectors, host cells, pharmaceutical compositions, methods of making, and method of treating conditions with the antibodies disclosed.

BRIEF DESCRIPTION OF THE DRAWINGS

FIG. 5A shows results obtained with control cells, cells expressing the 4F11 CAR with CD70, TCRa or both CD70 and TCR KOs, and cells expressing the P08F08 CAR with TCR KO; cells were obtained from Donor D419.

FIG. 5B shows results obtained with control cells, cells expressing the 4F11 CAR with or without a CD70 KO, and cells expressing the P08F08 CAR; cells were obtained from Donor D710.

FIG. 5C shows results obtained with control cells, cells expressing the 4F11 CAR with or without a CD70 KO, and cells expressing the P08F08 CAR; cells were obtained from Donor D503.

FIG. 6A shows a second-generation CAR design including an extracellular domain comprising an scFv specific for CD70, a hinge, a transmembrane domain, a first intracellular domain (a 4-1BB domain), and a second intracellular domain (a CD3ζ signaling domain).

FIG. 6B shows the SR2 CAR format in which a suicide switch is created by the insertion of two RTX epitopes (i.e. CD20 epitopes) between the hinge and the scFv.

FIG. 6C shows the RSRQR CAR format, which adds a third RTX epitope and the CD34 epitope.

FIG. 6D shows the RSR format, which two RTX epitopes flanking the scFv.

FIG. 6E shows a modification of the RSR CAR format in which the hinge domain is shorten (termed RSR-short).

FIG. 6F shows the R2S CAR format, in which the two RTX epitopes of the R2 CAR format are moved to N-terminal to the scFv.

FIGS. 8A-8D is a series of plots showing cell killing of 786-0, ACHN, or REH cells using CD70-specific CAR T cells where the CAR extracellular domain comprises the scFvs indicated in the legend in FIG. 8D. FIG. 8D is the legend.

FIG. 8A shows cell killing of 786-0, where the CAR extracellular domain comprises the scFvs indicated in the legend shown in FIG. 8D.

FIG. 8B shows cell killing of ACHN, where the CAR extracellular domain comprises the scFvs indicated in the legend shown in FIG. 8D.

FIG. 8C shows cell killing of REH, where the CAR extracellular domain comprises the scFvs indicated in the legend shown in FIG. 8D.

FIGS. 9A-9D are a series of plots showing serial killing of 786-0, ACHN, or REH cells using CD70-specific CAR T cells where the CAR extracellular domain comprises the scFvs indicated in the legend in FIG. 9D. FIG. 9D is the legend.

FIG. 9A is a plot showing the efficacy of CD70-specific CARs upon repeated exposure to luciferase-labeled 786-O target cells (CAR T cells were transferred to a 96-well plate containing fresh targets every 2-3 days). The E:T ratio was 3:1. The CARs were expressed in cells from donor D503.

FIG. 9B is a plot showing the efficacy of CD70-specific CARs upon repeated exposure to luciferase-labeled ACHN target cells (CAR T cells were transferred to a 96-well plate containing fresh targets every 2-3 days). The E:T ratio was 10:1. The CARs were expressed in cells from donor D503.

FIG. 9C is a plot showing the efficacy of CD70-specific CARs upon repeated exposure to luciferase-labeled REH target cells ($2\times10^6$ cells added at indicated time-points). The E:T ratio was 1:5. The CARs were expressed in cells from donor D503.

FIG. 12A shows the quantification of CD70 expression in terms of CD70 antibody binding capacity (ABC) on various tested cell lines.

FIG. 12B shows the quantification of CD70 expression in terms of CD70 antibody binding capacity (ABC) on RCC patient-derived cells.

FIG. 12C shows the data from RCC patient-derived cells.

FIG. 13A and FIG. 13B show killing of target cells from RCC patients, and antibody binding capacity.

FIG. 13C shows killing of target ACHN cells, and antibody binding capacity.

FIG. 14A is a bar graph showing quantification of CD70 receptor numbers of the 4F11 CAR in the QR3 format at 1:1 E:T for further cell lines expressing CD70 at varied levels.

FIG. 14B is a bar graph showing heme tumor-cell killing by 4F11 CAR in the QR3 format at 1:1 E:T for further cell lines expressing CD70 at varied levels.

FIG. 15A is a plot showing tumor volumes of mice treated with 4F11 and P08F08 CAR T at 10×10⁶ cell or 5×10⁶ cell dose in a subcutaneous xenograft model.

FIG. 15B is a plot showing body weights of mice treated with 4F11 and P08F08 CAR T at 10×10⁶ cell or 5×10⁶ cell dose in a subcutaneous xenograft model.

DETAILED DESCRIPTION

Figure 1:
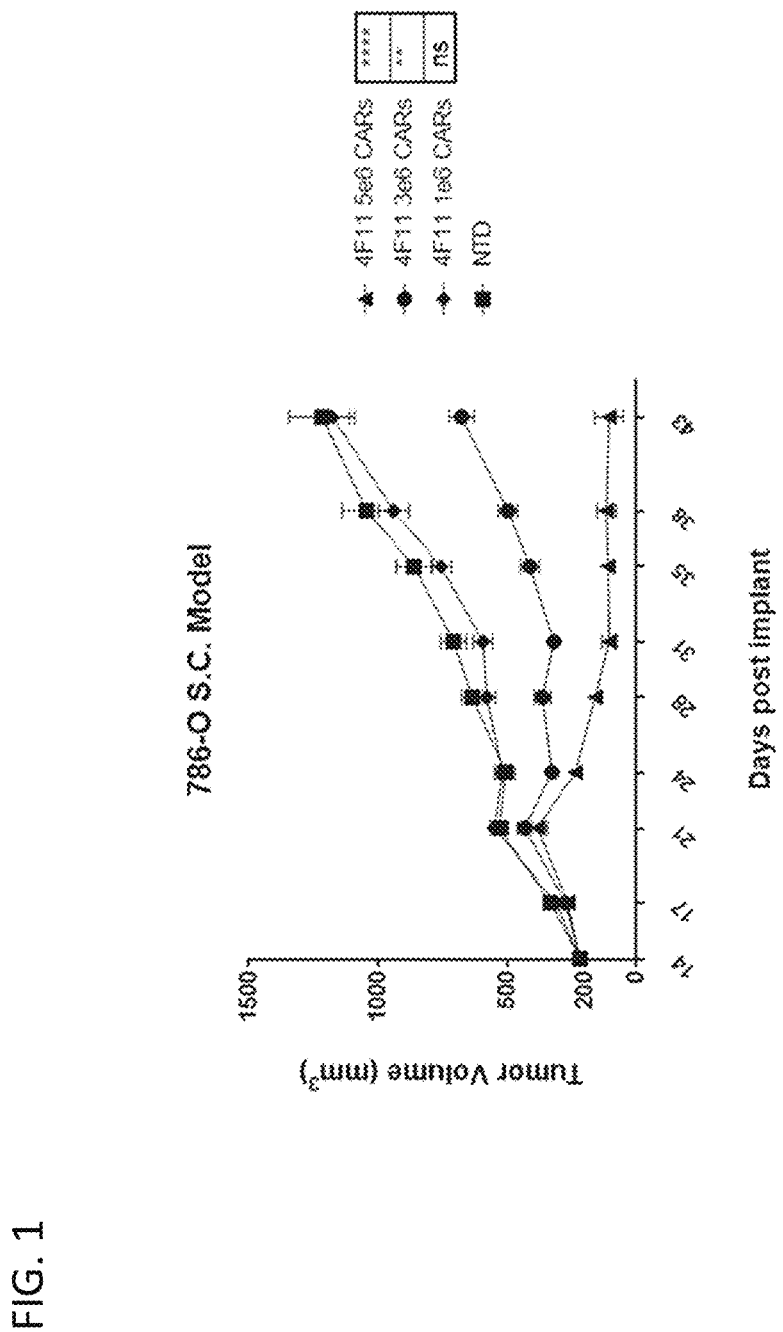
FIG. 1 is a plot showing. 1 tumor volumes of mice treated with different doses of 4F11 CAR T-cells in a subcutaneous xenograft model.

The disclosure disclosed herein provides chimeric antigen receptors (CARs) and immune cells comprising CARs (e.g. CAR-T cells) that specifically bind to CD70 (e.g., human CD70). The disclosure also provides polynucleotides encoding these CARs, compositions comprising these CAR-T cells, and methods of making and using these CARs and CAR-T cells. The disclosure also provides methods for treating a condition associated with malignant CD70 expression in a subject, such as cancer.

General Techniques

The compositions and methods of the disclosure will employ, unless otherwise indicated, conventional techniques of molecular biology (including recombinant techniques), microbiology, cell biology, biochemistry and immunology, which are within the skill of the art. Such techniques are explained fully in the literature, such as, Molecular Cloning: A Laboratory Manual, second edition (Sambrook et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-1998) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel et al., eds., 1987); PCR: The Polymerase Chain Reaction, (Mullis et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty, ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995).

Definitions

The term "extracellular ligand-binding domain" as used herein refers to an oligo- or polypeptide that is capable of binding a ligand. In some exemplary embodiments, the domain will be capable of interacting with a cell surface molecule. For example, the extracellular ligand-binding domain may be chosen to recognize a ligand that acts as a cell surface marker on target cells associated with a particular disease state.

The term "stalk domain" or "hinge domain" are used interchangeably herein to refer to any oligo- or polypeptide that functions to link the transmembrane domain to the extracellular ligand-binding domain in a CAR. In particular, stalk domains are used to provide more flexibility and accessibility for the extracellular ligand-binding domain.

The term "intracellular signaling domain" refers to the portion of a protein which transduces the effector signal function signal and directs the cell to perform a specialized function.

A "co-stimulatory molecule" as used herein refers to the cognate binding partner on an immune cell, e.g., a T cell, that specifically binds with a co-stimulatory ligand, thereby mediating a co-stimulatory response by the cell, such as, but not limited to proliferation. Co-stimulatory molecules include, but are not limited to an MHC class I molecule, BTLA and Toll ligand receptor. Examples of costimulatory molecules include CD27, CD28, CD8, 4-1BB (CD137), OX40, CD30, CD40, PD-1, ICOS, lymphocyte function-associated antigen-1 (LFA-1), CD2, CD7, LIGHT, NKG2C, B7-H3 and a ligand that specifically binds with CD83 and the like.

A "co-stimulatory ligand" refers to a molecule on an antigen presenting cell that specifically binds a cognate co-stimulatory signal molecule on an immune cell, e.g., a T cell, thereby providing a signal which, in addition to the primary signal provided by, for instance, binding of a TCR/CD3 complex with an MHC molecule loaded with peptide, mediates a T cell response, including, but not limited to, proliferation activation, differentiation and the like. A co-stimulatory ligand can include but is not limited to CD7, B7-1 (CD80), B7-2 (CD86), PD-L1, PD-L2, 4-1BBL, OX40L, inducible costimulatory igand (ICOS-L), intercellular adhesion molecule (ICAM, CD30L, CD40, CD70, CD83, HLA-G, MICA, M1CB, HVEM, lymphotoxin β receptor, 3/TR6, ILT3, ILT4, an agonist or antibody that binds Toll ligand receptor and a ligand that specifically binds with B7-H3. A co-stimulatory ligand also encompasses, inter alia, an antibody that specifically binds with a co-stimulatory molecule present on a T cell, such as but not limited to, CD27, CD28, 4-1BB, OX40, CD30, CD40, PD-1, ICOS, lymphocyte function-associated antigen-1 (LFA-1), CD2, CD7, LTGHT, NKG2C, B7-H3, a ligand that specifically binds with CD83.

An "antibody" is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term encompasses not only intact polyclonal or monoclonal antibodies, but also fragments thereof (such as Fab, Fab', F(ab')2, Fv), single chain (scFv) and domain antibodies (including, for example, shark and camelid antibodies), and fusion proteins comprising an antibody, and any other modified configuration of the immunoglobulin molecule that comprises an antigen recognition site. An antibody includes an antibody of any class, such as IgG, IgA, IgE, IgD, or IgM (or sub-class thereof), and the antibody need not be of any particular class. Depending on the antibody amino acid sequence of the constant region of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant regions that correspond to the different classes of immunoglobulins are called alpha, delta, epsilon, gamma, and mu, respectively. The subunit structures and three-dimensional configurations of different classes of immunoglobulins are well known.

The term "antigen binding fragment" or "antigen binding portion" of an antibody, as used herein, refers to one or more fragments of an intact antibody that retain the ability to specifically bind to a given antigen (e.g., CD70). Antigen binding functions of an antibody can be performed by fragments of an intact antibody. Examples of binding fragments encompassed within the term "antigen binding fragment" of an antibody include Fab; Fab'; F(ab')$_2$; an Fd fragment consisting of the VH and CH1 domains; an Fv fragment consisting of the VL and VH domains of a single arm of an antibody; a single domain antibody (dAb) fragment (Ward et al., Nature 341:544-546, 1989), and an isolated complementarity determining region (CDR).

An antibody, an antigen-binding fragment, an antibody conjugate, or a polypeptide that "preferentially binds" or "specifically binds" (used interchangeably herein) to a target (e.g., CD70 protein) is a term well understood in the art, and methods to determine such specific or preferential binding are also well known in the art. A molecule is said to exhibit "specific binding" or "preferential binding" if it reacts or associates more frequently, more rapidly, with greater duration and/or with greater affinity with a particular cell or substance than it does with alternative cells or substances. An antibody "specifically binds" or "preferentially binds" to a target if it binds with greater affinity, avidity, more readily, and/or with greater duration than it binds to other substances. For example, an antibody that specifically or preferentially binds to a CD70 epitope is an antibody that binds this epitope with greater affinity, avidity, more readily, and/or with greater duration than it binds to other CD70 epitopes or non-CD70 epitopes. It is also understood that by reading this definition, for example, an antibody (or moiety or epitope) that specifically or preferentially binds to a first target may or may not specifically or preferentially bind to a second target. As such, "specific binding" or "preferential binding" does not necessarily require (although it can include) exclusive binding. Generally, but not necessarily, reference to binding means preferential binding.

A "variable region" of an antibody refers to the variable region of the antibody light chain or the variable region of the antibody heavy chain, either alone or in combination. As known in the art, the variable regions of the heavy and light chain each consist of four framework regions (FR) connected by three complementarity determining regions (CDRs) also known as hypervariable regions. The CDRs in each chain are held together in close proximity by the FRs and, with the CDRs from the other chain, contribute to the formation of the antigen binding site of antibodies. There are at least two techniques for determining CDRs: (1) an approach based on cross-species sequence variability (i.e., Kabat et al. Sequences of Proteins of Immunological Interest, (5th ed., 1991, National Institutes of Health, Bethesda Md.); and (2) an approach based on crystallographic studies of antigen-antibody complexes (Al-lazikani et al., 1997, J. Molec. Biol. 273:927-948). As used herein, a CDR may refer to CDRs defined by either approach or by a combination of both approaches.

A "CDR" of a variable domain are amino acid residues within the variable region that are identified in accordance with the definitions of the Kabat, Chothia, the accumulation of both Kabat and Chothia, AbM, contact, and/or conformational definitions or any method of CDR determination well known in the art. Antibody CDRs may be identified as the hypervariable regions originally defined by Kabat et al. See, e.g., Kabat et al., 1992, Sequences of Proteins of Immunological Interest, 5th ed., Public Health Service, NIH, Washington D.C. The positions of the CDRs may also be identified as the structural loop structures originally described by Chothia and others. See, e.g., Chothia et al., Nature 342:877-883, 1989. Other approaches to CDR identification include the "AbM definition," which is a compromise between Kabat and Chothia and is derived using Oxford Molecular's AbM antibody modeling software (now Accelrys®), or the "contact definition" of CDRs based on observed antigen contacts, set forth in MacCallum et al., J. Mol. Biol., 262:732-745, 1996. In another approach, referred to herein as the "conformational definition" of CDRs, the positions of the CDRs may be identified as the residues that make enthalpic contributions to antigen binding. See, e.g., Makabe et al., Journal of Biological Chemistry, 283:1156-1166, 2008. Still other CDR boundary definitions may not strictly follow one of the above approaches, but will nonetheless overlap with at least a portion of the Kabat CDRs, although they may be shortened or lengthened in light of prediction or experimental findings that particular residues or groups of residues or even entire CDRs do not significantly impact antigen binding. As used herein, a CDR may refer to CDRs defined by any approach known in the art, including combinations of approaches. The methods used herein may utilize CDRs defined according to any of these approaches. For any given embodiment containing more than one CDR, the CDRs may be defined in accordance with any of Kabat, Chothia, extended, AbM, contact, and/or conformational definitions.

As used herein, "monoclonal antibody" refers to an antibody obtained from a population of substantially homogeneous antibodies, i.e., the individual antibodies comprising the population are identical except for possible naturally-occurring mutations that may be present in minor amounts. Monoclonal antibodies are highly specific, being directed against a single antigenic site. Furthermore, in contrast to polyclonal antibody preparations, which typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the disclosure may be made by the hybridoma method first described by Kohler and Milstein, Nature 256:495, 1975, or may be made by recombinant DNA methods such as described in U.S. Pat. No. 4,816,567. The monoclonal antibodies may also be isolated from phage libraries generated using the techniques described in McCafferty et al., Nature 348:552-554, 1990, for example.

As used herein, "humanized" antibody refers to forms of non-human (e.g. murine) antibodies that are chimeric immunoglobulins, immunoglobulin chains, or fragments thereof (such as Fv, Fab, Fab', F(ab')2 or other antigen binding subsequences of antibodies) that contain minimal sequence derived from non-human immunoglobulin. In some exemplary embodiments, humanized antibodies are human immunoglobulins (recipient antibody) in which residues from a complementarity determining region (CDR) of the recipient are replaced by residues from a CDR of a non-human species (donor antibody) such as mouse, rat, or rabbit having the desired specificity, affinity, and capacity. In some instances, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Exemplary embodiments are antibodies having Fc regions modified as described in WO 99/58572. Other forms of humanized antibodies have one or more CDRs (CDR L1, CDR L2, CDR L3, CDR H1, CDR H2, or CDR H3) which are altered with respect to the original antibody, which are also termed one or more CDRs "derived from" one or more CDRs from the original antibody.

As used herein, "human antibody" means an antibody having an amino acid sequence corresponding to that of an antibody produced by a human and/or which has been made using any of the techniques for making human antibodies known to those skilled in the art or disclosed herein. This definition of a human antibody includes antibodies comprising at least one human heavy chain polypeptide or at least one human light chain polypeptide. One such example is an antibody comprising murine light chain and human heavy chain polypeptides. Human antibodies can be produced using various techniques known in the art. In some embodiments, the human antibody is selected from a phage library, where that phage library expresses human antibodies (Vaughan et al., Nature Biotechnology, 14:309-314, 1996; Sheets et al., Proc. Natl. Acad. Sci. (USA) 95:6157-6162, 1998; Hoogenboom and Winter, J. Mol. Biol., 227:381, 1991; Marks et al., J. Mol. Biol., 222:581, 1991). Human antibodies can also be made by immunization of animals into which human immunoglobulin loci have been transgenically introduced in place of the endogenous loci, e.g., mice in which the endogenous immunoglobulin genes have been partially or completely disrupted or inactivated. This approach is described in U.S. Pat. Nos. 5,545,807; 5,545,806; 5,569,825; 5,625,126; 5,633,425; and 5,661,016. Alternatively, the human antibody may be prepared by immortalizing human B lymphocytes that produce an antibody directed against a target antigen (such B lymphocytes may be recovered from an individual or from single cell cloning of the cDNA, or may have been immunized in vitro). See, e.g., Cole et al. Monoclonal Antibodies and Cancer Therapy, Alan R. Liss, p. 77, 1985; Boerner et al., J. Immunol., 147(1):86-95, 1991; and U.S. Pat. No. 5,750,373.

The term "chimeric antibody" is intended to refer to antibodies in which the variable region sequences are derived from one species and the constant region sequences are derived from another species, such as an antibody in which the variable region sequences are derived from a mouse antibody and the constant region sequences are derived from a human antibody.

The terms "polypeptide", "oligopeptide", "peptide," and "protein" are used interchangeably herein to refer to chains of amino acids of any length—in some embodiments, relatively short (e.g., 10-100 amino acids). The chain may be linear or branched, it may comprise modified amino acids, and/or may be interrupted by non-amino acids. The terms also encompass an amino acid chain that has been modified naturally or by intervention; for example, disulfide bond formation, glycosylation, lipidation, acetylation, phosphorylation, or any other manipulation or modification, such as conjugation with a labeling component. Also included within the definition are, for example, polypeptides containing one or more analogs of an amino acid (including, for example, unnatural amino acids, etc.), as well as other modifications known in the art. It is understood that the polypeptides can occur as single chains or associated chains.

A "monovalent antibody" comprises one antigen binding site per molecule (e.g., IgG or Fab). In some instances, a monovalent antibody can have more than one antigen binding sites, but the binding sites are from different antigens.

A "bivalent antibody" comprises two antigen binding sites per molecule (e.g., IgG). In some instances, the two binding sites have the same antigen specificities. However, bivalent antibodies may be bispecific.

Antibodies of the disclosure can be produced using techniques well known in the art, e.g., recombinant technologies, phage display technologies, synthetic technologies or combinations of such technologies or other technologies readily known in the art (see, for example, Jayasena, S. D., Clin. Chem., 45: 1628-50, 1999 and Fellouse, F. A., et al, J. Mol. Biol., 373(4):924-40, 2007).

As known in the art, "polynucleotide" or "nucleic acid," as used interchangeably herein, refer to chains of nucleotides of any length, and include DNA and RNA. The nucleotides can be deoxyribonucleotides, ribonucleotides, modified nucleotides or bases, and/or their analogs, or any substrate that can be incorporated into a chain by DNA or RNA polymerase. A polynucleotide may comprise modified nucleotides, such as methylated nucleotides and their analogs. If present, modification to the nucleotide structure may be imparted before or after assembly of the chain. The sequence of nucleotides may be interrupted by non-nucleotide components. A polynucleotide may be further modified after polymerization, such as by conjugation with a labeling component. Other types of modifications include, for example, "caps", substitution of one or more of the naturally occurring nucleotides with an analog, internucleotide modifications such as, for example, those with uncharged linkages (e.g., methyl phosphonates, phosphotriesters, phosphoamidates, carbamates, etc.) and with charged linkages (e.g., phosphorothioates, phosphorodithioates, etc.), those containing pendant moieties, such as, for example, proteins (e.g., nucleases, toxins, antibodies, signal peptides, poly-L-lysine, etc.), those with intercalators (e.g., acridine, psoralen, etc.), those containing chelators (e.g., metals, radioactive metals, boron, oxidative metals, etc.), those containing alkylators, those with modified linkages (e.g., alpha anomeric nucleic acids, etc.), as well as unmodified forms of the polynucleotide(s). Further, any of the hydroxyl groups ordinarily present in the sugars may be replaced, for example, by phosphonate groups, phosphate groups, protected by standard protecting groups, or activated to prepare additional linkages to additional nucleotides, or may be conjugated to solid supports. The 5' and 3' terminal OH can be phosphorylated or substituted with amines or organic capping group moieties of from 1 to 20 carbon atoms. Other hydroxyls may also be derivatized to standard protecting groups. Polynucleotides can also contain analogous forms of ribose or deoxyribose sugars that are generally known in the art, including, for example, 2'-O-methyl-, 2'-O-allyl, 2'-fluoro- or 2'-azido-ribose, carbocyclic sugar analogs, alpha- or beta-anomeric sugars, epimeric sugars such as arabinose, xyloses or lyxoses, pyranose sugars, furanose sugars, sedoheptuloses, acyclic analogs and abasic nucleoside analogs such as methyl riboside. One or more phosphodiester linkages may be replaced by alternative linking groups. These alternative linking groups include, but are not limited to, embodiments wherein phosphate is replaced by P(O)S("thioate"), P(S)S ("dithioate"), (O)NR$_2$ ("amidate"), P(O)R, P(O)OR', CO or CH$_2$ ("formacetal"), in which each R or R' is independently H or substituted or unsubstituted alkyl (1-20 C) optionally containing an ether (—O—) linkage, aryl, alkenyl, cycloalkyl, cycloalkenyl or araldyl. Not all linkages in a polynucleotide need be identical. The preceding description applies to all polynucleotides referred to herein, including RNA and DNA.

As known in the art a "constant region" of an antibody refers to the constant region of the antibody light chain or the constant region of the antibody heavy chain, either alone or in combination.

As used herein, "substantially pure" refers to material which is at least 50% pure (i.e., free from contaminants), at least 90% pure, at least 95% pure, at least 98% pure, or at least 99% pure.

A "host cell" includes an individual cell or cell culture that can be or has been a recipient for vector(s) for incorporation of polynucleotide inserts. Host cells include progeny of a single host cell, and the progeny may not necessarily be completely identical (in morphology or in genomic DNA complement) to the original parent cell due to natural, accidental, or deliberate mutation. A host cell includes cells transfected in vivo with a polynucleotide(s) of this disclosure.

As used herein, "immune cell" refers to a cell of hematopoietic origin functionally involved in the initiation and/or execution of innate and/or adaptative immune response.

As known in the art, the term "Fc region" is used to define a C-terminal region of an immunoglobulin heavy chain. The "Fc region" may be a native sequence Fc region or a variant Fc region. Although the boundaries of the Fc region of an immunoglobulin heavy chain might vary, the human IgG heavy chain Fc region is usually defined to stretch from an amino acid residue at position Cys226, or from Pro230, to the carboxyl-terminus thereof. The numbering of the residues in the Fc region is that of the EU index as in Kabat. Kabat et al., Sequences of Proteins of Immunological Interest, 5th Ed. Public Health Service, National Institutes of Health, Bethesda, Md., 1991. The Fc region of an immunoglobulin generally comprises two constant regions, CH2 and CH3.

As used in the art, "Fc receptor" and "FcR" describe a receptor that binds to the Fc region of an antibody. In some embodiments, the FcR is a native sequence human FcR. Moreover, in some embodiments, the FcR is one which binds an IgG antibody (a gamma receptor) and includes receptors of the FcγRI, FcγRII, and FcγRIII subclasses, including allelic variants and alternatively spliced forms of these receptors. FcγRII receptors include FcγRIIA (an "activating receptor") and FcγRIIB (an "inhibiting receptor"), which have similar amino acid sequences that differ primarily in the cytoplasmic domains thereof. FcRs are reviewed in Ravetch and Kinet, Ann. Rev. Immunol., 9:457-92, 1991; Capel et al., Immunomethods, 4:25-34, 1994; and de Haas et al., J. Lab. Clin. Med., 126:330-41, 1995. "FcR" also includes the neonatal receptor, FcRn, which is responsible for the transfer of maternal IgGs to the fetus (Guyer et al., J. Immunol., 117:587, 1976; and Kim et al., J. Immunol., 24:249, 1994).

The term "compete", as used herein with regard to an antibody, means that a first antibody, or an antigen binding fragment (or portion) thereof, binds to an epitope in a manner sufficiently similar to the binding of a second antibody, or an antigen binding portion thereof, such that the result of binding of the first antibody with its cognate epitope is detectably decreased in the presence of the second antibody compared to the binding of the first antibody in the absence of the second antibody. The alternative, where the binding of the second antibody to its epitope is also detectably decreased in the presence of the first antibody, can, but need not be the case. That is, a first antibody can inhibit the binding of a second antibody to its epitope without that second antibody inhibiting the binding of the first antibody to its respective epitope. However, where each antibody detectably inhibits the binding of the other antibody with its cognate epitope or ligand, whether to the same, greater, or lesser extent, the antibodies are said to "cross-compete" with each other for binding of their respective epitope(s). Both competing and cross-competing antibodies are encompassed by the disclosure. Regardless of the mechanism by which such competition or cross-competition occurs (e.g., steric hindrance, conformational change, or binding to a common epitope, or portion thereof), the skilled artisan would appreciate, based upon the teachings provided herein, that such competing and/or cross-competing antibodies are encompassed and can be useful for the methods disclosed herein.

As used herein "autologous" means that cells, a cell line, or population of cells used for treating patients are originating from said patient.

As used herein "allogeneic" means that cells or population of cells used for treating patients are not originating from said patient but from a donor.

As used herein, "treatment" is an approach for obtaining beneficial or desired clinical results. For purposes of this disclosure, beneficial or desired clinical results include, but are not limited to, one or more of the following: reducing the proliferation of (or destroying) neoplastic or cancerous cells, inhibiting metastasis of neoplastic cells, shrinking or decreasing the size of CD70 expressing tumor such as a renal cell carcinoma (RCC) lymphoma, leukemia, or glioma, remission of a CD70 associated disease (e.g., cancer), decreasing symptoms resulting from a CD70 associated disease (e.g., cancer), increasing the quality of life of those suffering from a CD70 associated disease (e.g., cancer), decreasing the dose of other medications required to treat a CD70 associated disease (e.g., cancer), delaying the progression of a CD70 associated disease (e.g., cancer), curing a CD70 associated disease (e.g., cancer), and/or prolong survival of patients having a CD70 associated disease (e.g., cancer).

"Ameliorating" means a lessening or improvement of one or more symptoms as compared to not administering a CD70-specific CAR or a CD70-specific CAR-T-cell. "Ameliorating" also includes shortening or reduction in duration of a symptom.

As used herein, an "effective dosage" or "effective amount" of drug, compound, or pharmaceutical composition is an amount sufficient to effect any one or more beneficial or desired results. For prophylactic use, beneficial or desired results include eliminating or reducing the risk, lessening the severity, or delaying the onset of the disease, including biochemical, histological and/or behavioral symptoms of the disease, its complications and intermediate pathological phenotypes presenting during development of the disease. For therapeutic use, beneficial or desired results include clinical results such as reducing incidence or amelioration of one or more symptoms of various CD70 associated diseases or conditions (such as for example multiple myeloma), decreasing the dose of other medications required to treat the disease, enhancing the effect of another medication, and/or delaying the progression of the CD70 associated disease of patients. An effective dosage can be administered in one or more administrations. For purposes of this disclosure, an effective dosage of drug, compound, or pharmaceutical composition is an amount sufficient to accomplish prophylactic or therapeutic treatment either directly or indirectly. As is understood in the clinical context, an effective dosage of a drug, compound, or pharmaceutical composition may or may not be achieved in conjunction with another drug, compound, or pharmaceutical composition. Thus, an "effective dosage" may be considered in the context of administering one or more therapeutic agents, and a single agent may be considered to be given in an effective amount if, in conjunction with one or more other agents, a desirable result may be or is achieved.

An "individual," "patient," or a "subject" is a mammal—in some embodiments, a human. Mammals include, but are not limited to, humans, monkeys, pigs, and other farm animals, sport animals, pets, primates, horses, dogs, cats, rodents including mice, rats, guinea pigs, etc. A subject is a mammal and the terms are used interchangeably herein. In some embodiments, the subject is a human. In some embodiments, the subject is a non-human primate. In some embodiments, the subject is a human or a monkey, e.g., a cynomolgus monkey.

As used herein, "vector" means a construct, which is capable of delivering, and, in some embodiments, expressing, one or more gene(s) or sequence(s) of interest in a host cell. Examples of vectors include, but are not limited to, viral vectors, naked DNA or RNA expression vectors, plasmid, cosmid or phage vectors, DNA or RNA expression vectors associated with cationic condensing agents, DNA or RNA expression vectors encapsulated in liposomes, and certain eukaryotic cells, such as producer cells.

As used herein, "expression control sequence" means a nucleic acid sequence that directs transcription of a nucleic acid. An expression control sequence can be a promoter, such as a constitutive or an inducible promoter, or an enhancer. The expression control sequence is operably linked to the nucleic acid sequence to be transcribed.

As used herein, "pharmaceutically acceptable carrier" or "pharmaceutical acceptable excipient" includes any material which, when combined with an active ingredient, allows the ingredient to retain biological activity and is non-reactive with the subject's immune system. Examples include, but are not limited to, any of the standard pharmaceutical carriers such as a phosphate buffered saline solution, water, emulsions such as oil/water emulsion, and various types of wetting agents. Exemplary diluents for aerosol or parenteral administration are phosphate buffered saline (PBS) or normal (0.9%) saline. Compositions comprising such carriers are formulated by well known conventional methods (see, for example, Remington's Pharmaceutical Sciences, 18th edition, A. Gennaro, ed., Mack Publishing Co., Easton, Pa., 1990; and Remington, The Science and Practice of Pharmacy 21st Ed. Mack Publishing, 2005).

The term "$k_{on}$", as used herein, refers to the rate constant for association of an antibody or scFv or CAR to an antigen.

The term "$k_{off}$", as used herein, refers to the rate constant for dissociation of an antibody or scFv or CAR from the antibody/antigen complex.

The term "$K_D$", as used herein, refers to the equilibrium dissociation constant of an antibody-antigen or scFv-antigen or CAR-antigen interaction.

Reference to "about" a value or parameter herein includes (and describes) embodiments that are directed to that value or parameter per se. For example, description referring to "about X" includes description of "X." Numeric ranges are inclusive of the numbers defining the range.

It is understood that wherever embodiments are described herein with the language "comprising," otherwise analogous embodiments described in terms of "consisting of" and/or "consisting essentially of" are also provided.

Where aspects or embodiments of the invention are described in terms of a Markush group or other grouping of alternatives, the invention encompasses not only the entire group listed as a whole, but each member of the group individually and all possible subgroups of the main group, but also the main group absent one or more of the group members. The invention also envisages the explicit exclusion of one or more of any of the group members in the claimed invention.

Unless otherwise defined, all technical and scientific terms used herein have the same meaning as commonly understood by one of ordinary skill in the art to which this disclosure belongs. In case of conflict, the present specification, including definitions, will control. Throughout this specification and claims, the word "comprise," or variations such as "comprises" or "comprising" will be understood to imply the inclusion of a stated integer or group of integers but not the exclusion of any other integer or group of integers. Unless otherwise required by context, singular terms shall include pluralities and plural terms shall include the singular.

Exemplary methods and materials are described herein, although methods and materials similar or equivalent to those described herein can also be used in the practice or testing of the invention. The materials, methods, and examples are illustrative only and not intended to be limiting.

CD70-Specific Cars and Methods of Making Thereof

The instant disclosure provides CARs that bind to CD70 (e.g., human CD70 (e.g., SEQ ID NO: 335), such as those deposited under the provisions of the Budapest Treaty and assigned accession number: P32970-1. CD70-specific CARs provided herein include single chain CARS and multichain CARs. In some embodiments, the CARs have the ability to redirect T cell specificity and reactivity toward CD70 in a non-MHC-restricted manner, exploiting the antigen-binding properties of monoclonal antibodies. The non-MHC-restricted antigen recognition gives T cells expressing CARs the ability to recognize an antigen independent of antigen processing, thus bypassing a major mechanism of tumor escape.

In some embodiments, CARs provided herein comprise an extracellular ligand-binding domain (e.g., a single chain variable fragment (scFv)), a transmembrane domain, and an intracellular signaling domain. In some embodiments, the CARs provided herein further comprises a "hinge" or "stalk" domain, which can be situated between the extraceullar ligand-binding domain and the transmembrane domain. In some embodiments, the extracellular ligand-binding domain, transmembrane domain, and intracellular signaling domain are in one polypeptide, i.e., in a single chain. Multichain CARs and polypeptides are also provided herein. In some embodiments, the multichain CARs comprise: a first polypeptide comprising a transmembrane domain and at least one extracellular ligand-binding domain, and a second polypeptide comprising a transmembrane domain and at least one intracellular signaling domain, wherein the polypeptides assemble together to form a multichain CAR. In some embodiments, the CARs are inducible, such as by small molecule (e.g., AP1903) or protein (e.g., Epo, Tpo, or PD-1). In some embodiments, a CD70-specific multichain CAR is based on the high affinity receptor for IgE (FcεRI). The FcεRI expressed on mast cells and basophiles triggers allergic reactions. FcεRI is a tetrameric complex composed of a single α subunit, a single β subunit, and two disulfide-linked γ subunits. The a subunit contains the IgE-binding domain. The β and γ subunits contain ITAMs that mediate signal transduction. In some embodiments, the extracellular domain of the FcRα chain is deleted and replaced by a CD70-specific extracellular ligand-binding domain. In some embodiments, the multichain CD70-specific CAR comprises an scFv that binds specifically to CD70, the CD8α hinge, and the ITAM of the FcRβ chain. In some embodiments, the CAR may or may not comprise the FcRγ chain.

In some embodiments, the extracellular ligand-binding domain comprises an scFv comprising the light chain variable (VL) region and the heavy chain variable (VH) region of a target antigen (i.e., CD70) specific monoclonal antibody joined by a flexible linker. Single chain variable region fragments are made by linking light and/or heavy chain variable regions by using a short linking peptide (Bird et al., Science 242:423-426, 1988). An example of a linking peptide is the GS linker having the amino acid sequence (GGGGS)₃ (SEQ ID NO: 296), which bridges approximately 3.5 nm between the carboxy terminus of one variable region and the amino terminus of the other variable region. Linkers of other sequences have been designed and used (Bird et al., 1988, supra). Other exemplary linkers can generally include other GS linkers can generally include (GGGGS)x, where x is 1, 2, 3, 4, 5 (SEQ ID NO: 613). In some embodiments, x is 6, 7, 8, 9, 10, 11, 12, 13, 14, 15, or any integer less than about 20. In some embodiments, the linker is (GGGGS)₄ (SEQ ID NO: 602). In some embodiments the linker is GSTSGSGKPGSGEGSTKG (SEQ ID NO: 612), as described in Whitlow et al, *Protein Eng.* (1993) 6(8): 989-895. In general, linkers can be short, flexible polypeptides, which in some embodiments are comprised of about 20 or fewer amino acid residues. Linkers can in turn be modified for additional functions, such as attachment of drugs or attachment to solid supports. The single chain variants can be produced either recombinantly or synthetically. For synthetic production of scFv, an automated synthesizer can be used. For recombinant production of scFv, a suitable plasmid containing polynucleotide that encodes the scFv can be introduced into a suitable host cell, either eukaryotic, such as yeast, plant, insect or mammalian cells, or prokaryotic, such as *E. coli*. Polynucleotides encoding the scFv of interest can be made by routine manipulations such as ligation of polynucleotides. The resultant scFv can be isolated using standard protein purification techniques known in the art.

In another aspect, provided is a CAR, which specifically binds to CD70, wherein the CAR comprises an extracellular ligand-binding domain comprising: a VH region comprising a VH CDR1, VH CDR2, and VH CDR3 of the VH sequence shown in SEQ ID NO: 2, 4, 6, 8, 10, 12, 14, 16, 18, 20, 22, 24, 26, 28, 30, 32, 34, 36, 38, 40, 42, 44, 46 or 48; and/or a VL region comprising VL CDR1, VL CDR2, and VL CDR3 of the VL sequence shown in SEQ ID NO: 1, 3, 5, 7, 9, 11, 13, 15, 17, 19, 21, 23, 25, 27, 29, 31, 33, 35, 37, 39, 41, 43, 45 or 47. In some embodiments, the VH and VL are linked together by a flexible linker. In some embodiments a flexible linker comprises the amino acid sequence shown in SEQ ID NO: 296.

In some embodiments, a CAR of the disclosure comprises an extracellular ligand-binding domain having any one of partial light chain sequence as listed in Table 1 and/or any one of partial heavy chain sequence as listed in Table 1. In Table 1, the underlined sequences are CDR sequences according to Kabat and in bold according to Chothia.

TABLE 1

| mAb | Light Chain | Heavy Chain |
| --- | --- | --- |
| 31H1 | DIVMTQNPLSSPVTLGQPASISC<u>RSS</u> <u>QSLVHSDGNTYLS</u>WLQQRPGQSPR LLIY<u>KISNRFS</u>GVPDRFSGSGAGTDF TLKISRVEAEDVGVYYC<u>MQATQFP LT</u>GGGSKVEIK (SEQ ID NO: 1) | QVQLVQSGAEVKKPGSSVKVSCKAS GGTFS<u>SYGFS</u>WVRQAPGQGLEWMG <u>GIIPIFGSANYAQKFQG</u>RVTITADKS TSTVYMELISLRSEDTAVYYCAR<u>GG SSSPFAY</u>WGQGTLVTVSS (SEQ ID NO: 2) |
| 63B2 | DIVMTQTPLSSPVTLGQPASISC<u>RSS</u> <u>QSLVHSDGNTYLS</u>WLQQRPGQSPR LLIY<u>KISNRFS</u>GVPDRFSGSGAGTDF TLKISRVEAEDVGVYYC<u>MQATQFP LT</u>GGGSKVEIK (SEQ ID NO: 3) | QVQLVQSGAEVKKPGSSVKVSCKAS GGTFS<u>SYGFS</u>WVRQAPGQGLEWMG <u>GIIPIFGTANYAQKFQG</u>RVTITADKS TSTVFMELISLRSEYTAVYYCAR<u>GGS SSPFAY</u>WGQGTLVTVSS (SEQ ID NO: 4) |
| 40E3 | DIQMTQSPSSLSASVGDRVTITC<u>RAS</u> <u>QGISNYLA</u>WFQQKPGKAPKSLIYA <u>ASSLQS</u>GVPSKFSGSGSGTDFTLTIS SLQPEDFATYYC<u>QQYNSYPLT</u>FGG GTKVEIK (SEQ ID NO: 5) | QVQLQESGPGLVKPSETLSLTCTVSG GSIS<u>SYYWN</u>WIRQPPGKGLEWIG<u>YIY YSGSTNYNPSLKS</u>RVTISVDTSKNQF SLKLRSVTAADTAVYYCAR<u>DIRTW</u> GQGTLVTVSS (SEQ ID NO: 6) |
| 42C3 | DVVMTQSPLSLPVTLGQPASISC<u>RSS</u> <u>QSLVYSDENTYLN</u>WFQQRPGQSLR RLIY<u>QVSNRDS</u>GVPDRFSGSGSGTD FTLKISRVEAEDVGVYFC<u>MQGTYW PPT</u>FGGGTKVEIK (SEQ ID NO: 7) | EVQLVESGGGLVQPGGSLRLSCAAS GFTFR<u>NSWMS</u>WVRQAPGKGLEWV <u>ANIKRDGSEKYYVDSVKG</u>RFTISRD NAKNSLYLQMNSLRAEDTAVYYCA R<u>DQTGSFDY</u>WGQGTLVTVSS (SEQ ID NO: 8) |
| 45F11 | EIVMTQSPATLSMSLGERATLSC<u>RA SQSVSSSLA</u>WYQQKPGQAPRLLIY<u>G</u> <u>ASTRAT</u>GIPARFGGSGSGTEFTLTIS SLQSEDFAVYYC<u>QQYINWPH</u>FGGG TKVEIK (SEQ ID NO: 9) | QVQLRGSGPGLVKPSETLSLTCTVSD DSIS<u>VYYWS</u>WIRQPAGKGLEWIG<u>RV YSSGNINYNPSLESR</u>VTMSVDTSKSR FSLNLSSVTAADTAVYYCAR<u>GLDAF DI</u>WGQGTMVTVSS (SEQ ID NO: 10) |

TABLE 1-continued

| mAb | Light Chain | Heavy Chain |
|---|---|---|
| 64F9 | DIQMTQSPSSLSASVGDRVTITCQAS QDISNYLNWYQQKPGKAPKILIYG ASNLETGVPSRFSGSGSGTDFTFAIS SLQPEDVATYYCQQYDNFPITFGQ GTRLEIK (SEQ ID NO: 11) | EVQLLESGGGLVQPGESLRLSCEVSG FTFTSYAMSWVRQVPGKGLEWVSII SGVAFTTYYADSVKGRFTISRDHSK NTLYLQMNGLRAEDTAVYYCVKVD GEVYWGQGTLVTVSS (SEQ ID NO: 12) |
| 72C2 | EIVMTQSPDTLSVSPGERAILSCRAS QSVSSNLAWYQQKPGQAPRLLIYS ASTRASGIPARFSGSGSGTEFTLSISS LQSEDFAVYYCQQYDNWPPLTFG GGTKVEIK (SEQ ID NO: 13) | QVQLVQSGAEVKKPGSSVKVSCEAS GGTFITYAISWVRQAPGQGLEWMG GIIPFFGTANYAQKFQGRVTITADKS TSTASMELRSLRSEDTAMYYCAQW ELFFFDFWGQGTPVTVSS (SEQ ID NO: 14) |
| 2F10 | EIVLTQSPGTLSLSPGERATLSCRAS QSVSSSYLAWYQQQPGQAPRLLIY GASSRATGIPDRFSGSGSGTDFTLTI SRLEPEDFAIYYCQQYGSSPLTFGG GTKVEIK (SEQ ID NO: 15) | AVQLVESGGGLVQPGGSLRLSCAAS GFTFTYYSMNWVRQAPGKGLEWVS HISIRSSTIYFADSAKGRFTISRDNAK NSLYLQMNSLRDEDTAVYYCARGS GWYGDYFDYWGQGTLVTVSS (SEQ ID NO: 16) |
| 4F11 | DIQMTQSPSAMSASVGDRVTITCRA SQDISNYLAWFQQKPGKVPKRLIYA ASSLQSGVPSRFSGSGSGTEFTLTISS LLPEDFATYYCLQLNSFPFTFGGGT KVEIN (SEQ ID NO: 17) | QVTLKESGPVLVKPTETLTLTCTVSG FSLSNARMGVTWIRQPPGKALEWL AHIFSNDEKSYSTSLKSRLTISKDTSK TQVVLTMTNMDPVDTATYYCARIR DYYDISSYYDYWGQGTLVSVSS (SEQ ID NO: 18) |
| 10H10 | DIQMTQSPSSVSASVGDRVTITCRAS QGISSWLAWYQQKPGKAPKVLIYA ASSLQSGVPSRFSGSGSGTDFTLTIS SLQPEDFATYYCQQAFSFPFTFGPG TKVDIK (SEQ ID NO: 19) | EVQLVESGGGLVQPGGSLRLSCAVS GFTFSNHIHWVRQAPGKGLEWISY ISRSSSTIYYADSVKGRFTISRDNAKN SLYLQMNSLRDEDTAVYYCARDHA QWYGMDVWGQGTTVTVSS (SEQ ID NO: 20) |
| 17G6 | DIVMTQSPDSLAVSLGERATINCKSS QSVLYSYNNKNYVAWYQQKPGQP PNLLIFWASTRESGVPDRFSGSGSG TDFTLTISSLQAEDVAVYYCQQYYS TLTFGGGTKVEIK (SEQ ID NO: 21) | EVQLVESGGGLVQPGGSLRLSCVAS GFTFSSYWMSWVRQAPGKGLEWV ASIKQDGSEKYYVDSVKGRFTISRD NAKNSVYLQMNSLRAEDTGVYYCA REGVNWGWRLYWHFDLWGRGTL VTVSS (SEQ ID NO: 22) |
| 65E11 | EIVLTQSPGTLSLSPGERVTLSCRAS QSVSSSYLAWYQQKPGQAPRLLIY DASSRATGIPDRFSGSGSGTDFTLTI SRLEPEDFAVYYCQQYGSSPLTFGG GTKVEIK (SEQ ID NO: 23) | EVQVVESGGGLVQPGGSLRLSCAAS GFTFSSYSMNWVRQAPGKGLEWVS HSSISRGNIYFADSVKGRFTISRDNA KNSLYLQMNSLRDEDTAVYYCARG SGWYGDYFDYWGQGTLVTVSS (SEQ ID NO: 24) |
| P02B10 | ELQSVLTQPPSASGTPGQRVTISCSG SSSNIGSNYVYWYQQLPGTAPKLLI YRNNQRPSGVPDRFSGSKSGTSASL AISGLRSEDEADYYCAAWDDSLSG VVFGGGTKLTVL (SEQ ID NO: 25) | EVQLLESGGGLVQPGGSLRLSCAAS GFAFSNYAMSWVRQAPGKGLEWVS AIRGGGGSTYYADSVKGRFTISRDN SKNTLYLQMNSLRAEDTAVYYCAR DFISGTWYPDYWGQGTLVTVSS (SEQ ID NO: 26) |
| P07D03 | ELQSVLTQPPSASGTPGQRVTISCSG SRSNIGSNYVYWYQQLPGTAPKLLI YRNNQRPSGVPDRFSGSKSGTSASL AISGLRSEDEADYYCASWDGSLSA VVFGTGTKLTVL (SEQ ID NO: 27) | EVQLVQSGAEVKKPGESLKISCKGS GYRFTSYWIGWVRQMPGKGLEWM GSIYPDDSDTRYSPSFQGVTISADK SISTAYLQWSSLKASDTAMYYCASS TVDYPGYSYFDYWGQGTLVTVSS ((SEQ ID NO: 28) |
| P08A02 | ELQSVLTQPPSASGTPGQRVTISCSG SSSNIGSNYVYWYQQLPGTAPKLLI YRNNQRPSGVPDRFSGSKSGTSASL AISGLRSEDEADYYCATWDDSLGS PVFGTGTKLTVL (SEQ ID NO: 29) | EVQLVQSGAEVKKPGESLKISCKGS GYTFTNYWIAWVRQMPGKGLEWM GIIYPDGSDTRYSPSFQGVTISADKS ISTAYLQWSSLKASDTAMYYCARDI TSWYYGEPAFDIWGQGTLVTVSS ((SEQ ID NO: 30) |
| P08E02 | ELDIQMTQSPSSLSASVGDRVTITCR ASQSISRYLNWYQQKPGKAPKLLIY AASILQTGVPSRFSGSGSGTDFTLTI SSLQPEDFATYYCQQSYSTTMWTF GQGTKVEIK (SEQ ID NO: 31) | EVQLVQSGAEVKKPGESLKISCKGS GYSFTSSWIGWVRQMPGKGLEWMG IIYPGDSDTRYSPSFQGVTISADKSI STAYLQWSSLKASDTAMYYCAKGL SQAMTGFGFDYWGQGTLVTVSS (SEQ ID NO: 32) |

TABLE 1-continued

| mAb | Light Chain | Heavy Chain |
|---|---|---|
| P08F08 | ELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVL<br>(SEQ ID NO: 33) | EVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSS<br>((SEQ ID NO: 34) |
| P08G02 | ELDIQMTQSPSSLSASVGDRVTITCRASQSIYDYLHWYQQKPGKAPKLLIYDASNLQSGVPSRFSGSGSGTDFTLTISSLQPEDFATYYCQQSYTTPLFTFGQGTKVEIK<br>(SEQ ID NO: 35) | EVQLVQSGAEVKKPGESLKISCKGSGYTFPSSWIGWVRQMPGKGLEWMGIIYPDTSHTRYSPSFQGQVTISADKSISTAYLQWSSLKASDTAMYYCARASYFDRGTGYSSWWMDVWGQGTLVTVSS<br>((SEQ ID NO: 36) |
| P12B09 | ELDIQMTQSPSSLSASVGDRVTITCRASQYIGRYLNWYQQKRGKAPKLLIHGATSLASGVPSRFSGSGSGTDFTLTISSLQPEDFATYYCQQSYTTSPTFGQGTKVEIK<br>(SEQ ID NO: 37) | EVQLLESGGGLVQPGGSLRLSCAASGFTFSQYSMSWVRQAPGKGLEWVSAISGGGVSTYYADSVKGRFTISRDNSKNTLYLQMNSLRAEDTAVYYCASDISDSGGSHWYFDYWGQGTLVTVSS<br>(SEQ ID NO: 38) |
| P12F02 | ELQSVLTQPPSASGTPGQRVTISCSGSTSNIGRNYVYWYQQLPGTAPKLLIYRTNQRPSGVPDRFSGSKSGTSASLAISGLRSEDEADYYCAAWDDSLSGRVFGTGTKLTVL<br>(SEQ ID NO: 39) | EVQLLESGGGLVQPGGSLRLSCAASGFTFSSYAMSWVRQAPGKGLEWVSTISGTGGTTYYADSVKGRFTISRDNSKNTLYLQMNSLRAEDTAVYYCAKVRAGIDPTASDVWGQGTLVTVSS<br>(SEQ ID NO: 40) |
| P12G07 | ELQSVLTQPPSASGTPGQRVTISCSGSSSNIGSNYVYWYQQLPGTAPKPLIYMNNQRPSGVPDRFSGSKSGTSASLAISGLRSEDEADYYCAAWDDSLSAVVFGTGTKLTVL<br>((SEQ ID NO: 41) | EVQLLESGGGLVQPGGSLRLSCAASGFTFNNFAMSWVRQAPGKGLEWVSGISGSGDNTYYADSVKGRFTISRDNSKNTLYLQMNSLRAEDTAVYYCAKDRDIGLGWYSYYLDVWGQGTLVTVSS<br>(SEQ ID NO: 42) |
| P13F04 | ELQSVLTQPPSASGTPGQRVTISCSGSNSNIGTNYVSWYQQLPGTAPKLLIYRSSRRPSGVPDRFSGSKSGTSASLAISGLRSEDEADYYCAAWDGSLSGHWVFGTGTKLTVL<br>(SEQ ID NO: 43) | QVQLVQSGAEVKKPGSSVKVSCKASGGTFSSYAISWVRQAPGQGLEWMGEIIIPIFGTASYAQKFQGRVTITADESTSTAYMELSSLRSEDTAVYYCARAGWDDSWFDYWGQGTLVTVSS<br>(SEQ ID NO: 44) |
| P15D02 | ELDIQMTQSPSSLSASVGDRVTITCRASQSIDTYLNWYQQKPGKAPKLLIYSASSLHSGVPSRFSGSGSGTDFTLTISSLQPEDFATYYCQQSYSTTAWTFGQGTKVEIK<br>(SEQ ID NO: 45) | EVQLVQSGAEVKKPGESLKISCKGSGYSFASYWIGWVRQMPGKGLEWMGVIYPGTSETRYSPSFQGQVTISADKSISTAYLQWSSLKASDTAMYYCAKGLSASASGYSFQYWGQGTLVTVSS<br>((SEQ ID NO: 46) |
| P16C05 | ELDIQMTQSPSSLSASVGDRVTITCRASQSIGQSLNWYQQKPGKAPKLLIYGASSLQSGVPSRFSGSGSGTDFTLTISSLQPEDFATYYCQQSYSTPITFGQGTKVEIK<br>(SEQ ID NO: 47) | EVQLVQSGAEVKKPGESLKISCKGSGYSFTDYWIGWVRQMPGKGLEWMGMISPGGSTTIYRPSFQGQVTISADKSISTAYLQWSSLKASDTAMYYCAREMYTGGYGGSWYFDYWGQGTLVTVSS(SEQ ID NO: 48) |
| 10A1 | DIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIK<br>(SEQ ID NO: 338) | QVQLQESGPGLVKPSETLSLTCTVSGGSISYYWTWIRQPPGKGLEWIGHIYYSGSTNYNPSLKSRVTISIDTSKNLFSLKLSSVTAADTAVYYCARAEGSIDAFDFWGQGTMVTVSS<br>(SEQ ID NO: 339) |
| 10E2 | DIQMTQSPSTLSASVGDRVTITCRASQSISSWLAWYQQKPGKAPKVLIYKASSLESGVPSRFSGSGSGTEFTLTINSLQPDDFATYYCQQYKSFSLTFGQGTKLEIK<br>(SEQ ID NO: 340) | EVQLVESGGGLIQPGGSLRLSCAASGFTVSSNYMTWVRQAPGKGLEWVSVIYSGGSTYYADSVKGRFTISRDNSKNTLYLQMNSLRAEDTAVYYCARNWGDYWGQGTLVTVSS<br>(SEQ ID NO: 341) |
| 11A1 | DIQMTQSPSTLSASVGDRVTITCRASQSISSWLAWYQQKPGKAPKVLIYKASTLESGVPSRFSGSGSGTEFTLTISSLQPDDFATYYCQQYNSYSYTFGHGTKLEIK<br>(SEQ ID NO: 342) | QVQLQESGPGLVKPSGTLSLTCTVSGGSIDYYFWNWFRQSPVKGLEWIGHVYDIGNTKYNPSLKSRVTISIDTSENQFSLKLNSVTAADTAVYYCARGEGAIDAFDIWGQGTMVTVSS<br>(SEQ ID NO: 343) |

TABLE 1-continued

| mAb | Light Chain | Heavy Chain |
|---|---|---|
| 11C1 | DIQMTQSPSILSASVGDRVTITCRAS QSVSSWLAWYQQKPGKAPKVLIYK ASSLESGVPSRFSGTGSGTEFTLTISS LQSDDFATYYCQQYNTYSHTFGQG TKLEIK (SEQ ID NO: 344) | QVQLQESGPGLVKPSETLSLNCTVSG GSISYYYWTWIRQPPGKGLEWIGHV IYSGTTNYNPSLKSRVTISVDTSKNQ FSLKLNSVTAADTAVYYCVRAEGSI DAFDLWGQGTMVTVSS (SEQ ID NO: 345) |
| 11D1 | AIQMTQSPSSLSASVGDRVTITCRAS QGIRNDLGWYQQKPGKAPKLLIYA ASSLQSGVPSRFSGSGSGTDFTLTIS SLQPEDFATYYCLQDYNYPFTFGPG TKVDIK (SEQ ID NO: 346) | QVQLVESGGGVVQPGRSLRLSCVAS GFTFSDYGIHWVRQAPGMGQEWVA VIWYDGSiKKYSDSVKGRFIISRDNS ENTVYLQMNSLRGEDTAIYYCARDE VGtfGAFDFWGQGTKVTVSS (SEQ ID NO: 347) |
| 11E1 | DIQMTQSPSSLSASVGDSITITCRAS QDIDNYLAWYQQKTGKVPKVLIYA ASALQSGVPSRFSGSGSGTDFTLTIS SLQPEDVATYYCQNYNSGPRTFGQ GTKVEIK (SEQ ID NO: 348) | QVQLQESGPGLVKPLQTLSLTCTVS GGSISSdgYYWSWIRQNPGKGLEWI GYMYYSGSTYYNPSLKSRVTISVDT SKNQFSLKLRSVTAADTAVYYCTRD FGWYFDLWGRGTLVTVSS (SEQ ID NO: 349) |
| 12A2 | DIQMTQSPSSLSASVGDRVTITCRAS QDISNYLTWYQQKPGRVPEVLIYA ASALQSGVPSRFSGSGSGTDFTLTIS SLQPEDVATYYCQNYNSAPRTFGQ GTKVEIK (SEQ ID NO: 350) | QVQLQESGPGLVKPSQSLSLTCSVSG GSVSSdgYYWSWIRQHPGKGLEWIG YIYYRRITDYNPSLKSRVNISLDTSK NQFSLKLSSVTAADTAVYYCARDFG WYFDLWGRGTLVAVSS (SEQ ID NO: 351) |
| 12C4 | DIVMTQSPLSLPVTPGEPASISCRSS QSLLHSNGYNYLDWYLQKPGQSP QVLILLGSNRASGVPDRVSASGSGT DFTLKISRMQAEDVGIYYCMQTLQ TPFTFGQGTKLEIK (SEQ ID NO: 352) | QVQLVQSGAEVKKPGASVKVSCKA SGYTFTGYYLHWVRQAPGQGLEW MGWINpNSGGTNYAQKFQGRVTMT RDTSITTAYMELSRLRIDDTAVYYCA RDRGVtmivDGMDDWGQGTTVTVSS (SEQ ID NO: 353) |
| 12C5 | DIQLTQSPSFLSASVGDRVIITCRAS QGINSHLAWYQQKPGKAPKLLIYY ASTLPSGVPSRFSGSGSGTEFTLTVT SLQPEDFATYYCQQLNHYPITFGQ GTRLDIN (SEQ ID NO: 354) | EVELVESGGGMVQPGRSLRLSCAAS GFTFSDYGMHWVRQAPGMGLEWV TVIWYDGSnKYYADSVKGRFTISRD NSKNTVFLQMNSLRAEDTAVYYCA RDEVGfvGAFDIWGQGTMVTVSS (SEQ ID NO: 355) |
| 12C6 | DIQLTQSPSFLSASVGDRVIITCRAS QGINSHLAWYQQKPGKAPKLLIYY ASTLPSGVPSRFSGSGSGTEFTLTVT SLQPEDFATYYCQQLNHYPITFGQ GTRLEIK (SEQ ID NO: 661) | EVELVESGGGMVQPGRSLRLSCAAS GFTFSDYGMHWVRQAPGMGLEWV TVIWYDGSnKYYADSVKGRFTISRD NSKNTVFLQMNSLRAEDTAVYYCA RDEVGfvGAFDIWGQGTMVTVSS (SEQ ID NO: 662) |
| 12D3 | DIQMTQSPSSLSASVGDRVTITCRAS QGISNYLAWYQQKPGKVPKLLIYA ASTLHSGVPSRFSGSGSGTDFTLTIS SLQPEDVATYYCQKYNSAPRTFGQ GTKVEIK (SEQ ID NO: 356) | QVQLQESGPGLVKPSQTLSLTCTVSG GSISSdgYYWSWIRQHPGKGLEWIGY MYYSGITYHNPSLKSRVTISVDTSKN QFSLRLSSVTAADTAVYYCARDFG WYFDLWGRGTLVTVSS (SEQ ID NO: 357) |
| 12D6 | DIQMTQSPSSLSASVGDRVTITCRAS QDISNYLAWYQQKPGKVPKLLIYA ASTLHSGVPSRFSGSGSGTDFTLTIS SLQPDDFAAYYCQKYNSAPRTFGQ GTKVEIK (SEQ ID NO: 358) | QVQLQESGPGLVKPSQTLSLTCTVSG GSISSdaYYWSWIRQHPGKGLEWIGY MYYSGITYYNPSLKSRVTISVDTSKN QFSLKLSSVTAADTAVYYCARDFG WYFDLWGRGTLVTVSS (SEQ ID NO: 359) |
| 12D7 | DIQLTQSPSFLSASVGDRVSITCRAS QDISSFLAWYQQKPGKAPVLLIYVA STLQSGVPSRFSGSGSGTEFTLTVSS LQPEDFATYYCQQLHVYPITFGQG TRLEIR (SEQ ID NO: 360) | QVQLVESGGGVVQPGRSLRLSCVAS GFTFSDYGIHWVRQAPGMGQEWVA VIWYDGSiKKYSDSVKGRFIISRDNS ENTVYLQMNSLRGEDTAIYYCARDE VGtfGAFDFWGQGTKVTVSS (SEQ ID NO: 361) |

TABLE 1-continued

| mAb | Light Chain | Heavy Chain |
|---|---|---|
| 12F5 | DIVMTQTPLSLPVTPGEPASISCRSSQSLLDSDDGNtYLDWYLQKPGQSPQLLIYTLSYRASGVPDRFSGSGSGTDFTLKISRVEAEDVGVYYCMQRIEFPFTFGPGTKVDIK<br>(SEQ ID NO: 362) | EVQLVESGGGLVKPGGSLRLSCAASGFTFSNAWMSWVRQAPGKGLEWVGRIKsktGGGTTDYAAPVKGRFTISRDDSKNTLYLQMNSLKTEDTAVYYCTSLIVGaiSLFDYWGQGTLVTVSS<br>(SEQ ID NO: 363) |
| 12H4 | DIQMTQSPSALSASVGDRVAITCRASQTISTWLAWYQQKPGKAPKVLIYKASNLESGVPSRFSGSGSGTEFTLTINSLQPDDFATYYCQQYQTFSHTFGQGTKLEIK<br>(SEQ ID NO: 364) | QVQLRESGPGLVKPSETLSLTCTISGGSISYYFWTWIRQPPGRGLEWIGQIYYSGNTNSNPSLKSRVTISIDTSKNQFSLKLTSVTVADTAVYYCVRAEGSIDAFDIWGQGTMVAVSS<br>(SEQ ID NO: 365) |
| 8C8 | DMQMTQSPSSLSASVGDRVTLTCRASQGISNYLAWFQLKPGKVPKLLIYAASTLQSGVPSRFSGSGSGTDFALTISSLQPEDVATYYCQKYNSAPLTFGGGTKVEIK<br>(SEQ ID NO: 366) | EVQLVESGGGLVKPGGSLRLSCVASGFTFSSYSMNWVRQFPGKGLEWVSSIStSSNYIHYADSLQGRFTISRDNAKNSLYLQMSSLRVEDTAVYYCVRDKGTtltnWYFDLWGRGTLVTVSS<br>(SEQ ID NO: 367) |
| 8F7 | DIVMTQSPLSLPVTPGEPASISCRSSQTLVHSNGYNYLNWYLQKPGQSPQLLIYLGSNRASGVPDRFSGSGSGSDFTLKISRMEAEDVGVYYCMQAIQTPYTFGQGTNVEIK<br>(SEQ ID NO: 368) | QVQLVESGGGVVQPGRSLRLSCGASGFTFSSYGMHWVRQAPGKGLEWVAVIWYDGSnKYYADSLKGRFTISRDNSKNTLYLQMNSLRAEDTAVYYCARDGYSgssDAFDIWGQGTMVTVSS<br>(SEQ ID NO: 369) |
| 8F8 | DIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIK<br>(SEQ ID NO: 370) | QVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSIDAFDFWGQGTLVAVSL<br>(SEQ ID NO: 371) |
| 9D8 | DIQMTQSPSSLSASVGDRIIFTCQASQDINNYLHWYQQKPGKAPKLLIYDASDWETGVPSRFSGSGSGTDFTFTISSLQPEDIATYYCQQYDHLPITFGQGTRVEIK<br>(SEQ ID NO: 372) | QVQLVQSGAEVTKPGASVKVSCKASGYIFTGYYIYWVRQAPGQGLEWMGWINpSSGGTNYAQKFQGRVTMARDTSISTAYMELSSLRSDDTAVYYCARDRKReyyynFGMDVWGQGTTVTVST<br>(SEQ ID NO: 373) |
| 9E10 | DIQMTQSPSSLSASVGDRVILTCQASQDISNYLHWYQQKPGKAPKLLIYDASDLETGVPSRFSGSGSGADFTFTISNLQPEDFATYYCQQYDHLPITFGQGTRLEIK<br>(SEQ ID NO: 374) | QVQLVQSGAEVTKPGASVKVSCKASGYTFTSHYIYWVRQAPGQGLEWMGWINpNSGGTNYAQKFQDRVTMARDTSISTAYMELSRLRSDDTAVYYCAKDRKReyyynFGMDVWGQGTTVTVSA<br>(SEQ ID NO: 375) |
| 9E5 | DIQMTQSPSSLSASVGDRVILTCQASQDISNYLHWYQQKPGKAPKLLIYDASDLETGVPSRFSGSGSGADFTFTISNLQPEDFATYYCQQYDHLPITFGQGTRLEIK<br>(SEQ ID NO: 376) | QVQLVQFGVEVRKPGASVKVSCKVSGFTFTSHYIYWVRQAPGQGLEWMGWINpNSGGTKYAQKFQDRVTMARDTSISTAYMELSRLRSDDTSVYYCVKDRKReyyynFGMDVWGQGTTVTVSS<br>(SEQ ID NO: 377) |
| 9F4 | DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK<br>(SEQ ID NO: 378) | EVQMLESGGGLIQPGGSLRLSCKTSGFTLSIYAIHWVRQAPGRGLEWVSSFGgRGSSTYFADSVKGRFTISRDASENSLYLHMNSLRAEDTAVYYCAKEKDWgRGFDYWGQGTLVTVSS<br>(SEQ ID NO: 379) |
| 9F8 | DIVMTQSPLSLPVTPGEPASISCRSSQSLLYSNGYNYLDWYLQKPGQSPQLLIFLNSNRASGVPDRFSGSGSGTDFTLKISRVEAEDVGVYFCMQALQTPLTFGGGTKVEIK<br>(SEQ ID NO: 380) | EVQLVESGGGLVKPGGSLRLSCAASGFTFSNYSMNWVRQAPGKGLEWVSSISsSTIYIYYADSVKGRFTISRDNAKKSLYLQMNSLRAEDTAVYYCARDIGWevftLGFDYWGQGTQVTVSS<br>(SEQ ID NO: 381) |

Also provided herein are CDR portions of extracellular ligand-binding domains of CARs to CD70 (including Chothia, Kabat CDRs, and CDR contact regions). Determination of CDR regions is well within the skill of the art. It is understood that in some embodiments, CDRs can be a combination of the Kabat and Chothia CDR (also termed "combined CRs" or "extended CDRs"). In some embodiments, the CDRs are the Kabat CDRs. In other embodiments, the CDRs are the Chothia CDRs. In other words, in embodiments with more than one CDR, the CDRs may be any of Kabat, Chothia, combination CDRs, or combinations thereof. Tables 2A-2B provide examples of CDR sequences provided herein.

TABLE 2A

Heavy Chain

| mAb | CDRH1 | CDRH2 | CDRH3 |
|---|---|---|---|
| 31H1 | SYGFS (SEQ ID NO: 49) (Kabat); GGTFSSY (SEQ ID NO: 50) (Chothia); GGTFSSYGFS (SEQ ID NO: 51) (Extended) | GIIPIFGSANYAQK FQG (SEQ ID NO: 52) (Kabat); IPIFGS (SEQ ID NO: 53) (Chothia) | GGSSSPFAY (SEQ ID NO: 54) |
| 63B2 | SYGFS (SEQ ID NO: 55) (Kabat); GGTFSSY (SEQ ID NO: 56) (Chothia) GGTFSSYGFS (Extended) (SEQ ID NO: 57) | GIIPIFGTANYAQK FQG (SEQ ID NO: 58) (Kabat); IPIFGT (SEQ ID NO: 59) (Chothia) | GGSSSPFAY (SEQ ID NO: 60) |
| 40E3 | SYYWN (SEQ ID NO: 61) (Kabat); GGSISSY (SEQ ID NO: 62) (Chothia); GGSISSYYWN (SEQ ID NO: 63) (Extended) | YIYYSGSTNYNPS LKS (SEQ ID NO: 64) (Kabat); YYSGS (SEQ ID NO: 65) (Chothia) | DIRTW (SEQ ID NO: 66) |
| 42C3 | NSWMS (SEQ ID NO: 67) (Kabat); GFTFRNS (SEQ ID NO: 68) (Chothia); GFTFRNSWMS (SEQ ID NO: 69) (Extended) | NIKRDGSEKYYV DSVKG (SEQ ID NO: 70) (Kabat); KRDGSE (SEQ ID NO: 71) (Chothia) | DQTGSFDY (SEQ ID NO: 72) |
| 45F11 | VYYWS (SEQ ID NO: 73) (Kabat); DDSISVY (SEQ ID NO: 74) (Chothia); DDSISVYYWS (SEQ ID NO: 75) (Extended) | VYSSGNINYNPSL ES (SEQ ID NO: 76) (Kabat); YSSGN (SEQ ID NO: 77) (Chothia) | GLDAFDI (SEQ ID NO: 78) |
| 64F9 | SYAMS (SEQ ID NO: 79) (Kabat); GFTFTSY (SEQ ID NO: 80) (Chothia); GFTFTSYAMS (SEQ ID NO: 81) (Extended) | RVYSSGNINYNPS LES (SEQ ID NO: 82) (Kabat); YSSGN (SEQ ID NO: 83) (Chothia) | GLDAFDI (SEQ ID NO: 84) |
| 72C2 | TYAIS (SEQ ID NO: 85) (Kabat); GGTFITY (SEQ ID NO: 86) (Chothia); GGTFITYAIS (SEQ ID NO: 87) (Extended) | GIIPFFGTANYAQ KFQG (SEQ ID NO: 88) (Kabat); IPFFGT (SEQ ID NO: 89) (Chothia) | WELFFFDF (SEQ ID NO: 90) |
| 2F10 | YYSMN (SEQ ID NO: 91) (Kabat); GFTFTYY (SEQ ID NO: 92) (Chothia); GFTFTYYSMN (SEQ ID NO: 93) (Extended) | HISIRSSTIYFADS AKG (SEQ ID NO: 94) (Kabat); SIRSST (SEQ ID NO: 95) (Chothia) | GSGWYGDYFDY (SEQ ID NO: 96) |
| 4F11 | NARMGVT (SEQ ID NO: 97) (Kabat); GFSLSNARM (SEQ ID NO: 98) (Chothia); GFSLSNARMGVT (SEQ ID NO: 99) (Extended) | HIFSNDEKSYSTS LKS (SEQ ID NO: 100) (Kabat); FSNDE (SEQ ID NO: 101) (Chothia) | IRDYYDISSYYDY (SEQ ID NO: 102) |
| 10H10 | NHNIH (SEQ ID NO: 103) (Kabat); GFTFSNH (SEQ ID NO: 104) (Chothia); GFTFSNHNIH (SEQ ID NO: 105) (Extended) | YISRSSSTIYYADS VKG (SEQ ID NO: 106) (Kabat); SRSSST (SEQ ID NO: 107) (Chothia) | DHAQWYGMDV (SEQ ID NO: 108) |

TABLE 2A-continued

| | Heavy Chain | | |
|---|---|---|---|
| mAb | CDRH1 | CDRH2 | CDRH3 |
| 17G6 | SYWMS (SEQ ID NO: 109) (Kabat); GFTFSSY (SEQ ID NO: 110) (Chothia); GFTFSSYWMS (SEQ ID NO: 111) (Extended) | SIKQDGSEKYYV DSVKG (SEQ ID NO: 112) (Kabat); KQDGSE (SEQ ID NO: 113) (Chothia) | EGVNWGWRLYW HFDL (SEQ ID NO: 114) |
| 65E11 | SYSMN (SEQ ID NO: 115) (Kabat); GFTFSSY (SEQ ID NO: 116) (Chothia); GFTFSSYSMN (SEQ ID NO: 117) (Extended) | HSSISRGNIYFADS VKG (SEQ ID NO: 118) (Kabat); SISRGN (SEQ ID NO: 119) (Chothia) | GSGWYGDYFDY (SEQ ID NO: 120) |
| P02B10 | NYAMS (SEQ ID NO: 121) (Kabat); GFAFSNY (SEQ ID NO: 122) (Chothia); GFAFSNYAMS (SEQ ID NO: 123) (Extended) | AIRGGGGSTYYA DSVKG (SEQ ID NO: 124) (Kabat); RGGGGS (SEQ ID NO: 125) (Chothia) | DFISGTWYPDY (SEQ ID NO: 126) |
| P07D03 | SYWIG (SEQ ID NO: 127) (Kabat); GYRFTSY (SEQ ID NO: 128) (Chothia); GYRFTSYWIG (SEQ ID NO: 129) (Extended) | SIYPDDSDTRYSP SFQG (SEQ ID NO: 130) (Kabat); YPDDSD (SEQ ID NO: 131) (Chothia) | STVDYPGYSYFD Y (SEQ ID NO: 132) |
| P08A02 | NYWIA (SEQ ID NO: 133) (Kabat); GYTFTNY (SEQ ID NO: 134) (Chothia); GYTFTNYWIA (SEQ ID NO: 135) (Extended) | IIYPDGSDTRYSPS FQG (SEQ ID NO: 136) (Kabat); YPDGSD (SEQ ID NO: 137) (Chothia) | DITSWYYGEPAF DI (SEQ ID NO: 138) |
| P08E02 | SSWIG (SEQ ID NO: 139) (Kabat); GYSFTSS (SEQ ID NO: 140) (Chothia); GYSFTSSWIG (SEQ ID NO: 141) (Extended) | IIYPGDSDTRYSPS FQG (SEQ ID NO: 142) (Kabat); YPGDSD (SEQ ID NO: 143) (Chothia) | GLSQAMTGFGFD Y (SEQ ID NO: 144) |
| P08F08 | SYWIG (SEQ ID NO: 145) (Kabat); GYGFTSY (SEQ ID NO: 146) (Chothia); GYGFTSYWIG (SEQ ID NO: 147) (Extended) | IIHPDDSDTKYSPS FQG (SEQ ID NO: 148) (Kabat); HPDDSD (SEQ ID NO: 149) (Chothia) | SYLRGLWGGYFD Y (SEQ ID NO: 150) |
| P08G02 | SSWIG (SEQ ID NO: 151) (Kabat); GYTFPSS (SEQ ID NO: 152) (Chothia); GYTFPSSWIG (SEQ ID NO: 153) (Extended) | IIYPDTSHTRYSPS FQ (SEQ ID NO: 154) (Kabat); YPDTSH (SEQ ID NO: 155) (Chothia) | ASYFDRGTGYSS WWMDV (SEQ ID NO: 156) |
| P12B09 | QYSMS (SEQ ID NO: 157) (Kabat); GFTFSQY (SEQ ID NO: 158) (Chothia); GFTFSQYSMS (SEQ ID NO: 159) (Extended) | AISGGGVSTYYA DSVKG (SEQ ID NO: 160) (Kabat); SGGGVS (SEQ ID NO: 161) (Chothia) | DISDSGGSHWYF DY (SEQ ID NO: 162) |
| P12F02 | SYAMS (SEQ ID NO: 163) (Kabat); GFTFSSY (SEQ ID NO: 164) (Chothia); GFTFSSYAMS (SEQ ID NO: 165) (Extended) | TISGTGGTTYYAD SVKG (SEQ ID NO: 166) (Kabat); SGTGGT (SEQ ID NO: 167) (Chothia) | VRAGIDPTASDV (SEQ ID NO: 168) |
| P12G07 | NFAMS (SEQ ID NO: 169) (Kabat); GFTFNNF (SEQ ID NO: | GISGSGDNTYYA DSVKG (SEQ ID NO: 172) (Kabat); | DRDIGLGWYSYY LDV (SEQ ID NO: 174) |

TABLE 2A-continued

| | Heavy Chain | | |
|---|---|---|---|
| mAb | CDRH1 | CDRH2 | CDRH3 |
| | 170) (Chothia); GFTFNNFAMS (SEQ ID NO: 171) (Extended) | SGSGDN (SEQ ID NO: 173) (Chothia) | |
| P13F04 | SYAIS (SEQ ID NO: 175) (Kabat); GGTFSSY (SEQ ID NO: 176) (Chothia); GGTFSSYAIS (SEQ ID NO: 177) (Extended) | EIIPIFGTASYAQK FQG (SEQ ID NO: 178) (Kabat); IPIFGT (SEQ ID NO: 179) (Chothia) | AGWDDSWFDY (SEQ ID NO: 180) |
| P15D02 | SYWIG (SEQ ID NO: 181) (Kabat); GYSFASY (SEQ ID NO: 182) (Chothia); GYSFASYWIG (SEQ ID NO: 183) (Extended) | VIYPGTSETRYSPS FQG (SEQ ID NO: 184) (Kabat); YPGTSE (SEQ ID NO: 185) (Chothia) | GLSASASGYSFQ Y (SEQ ID NO: 186) |
| P16C05 | DYWIG (SEQ ID NO: 187) (Kabat); GYSFTDY (SEQ ID NO: 188) (Chothia); GYSFTDYWIG (SEQ ID NO: 189) (Extended) | MISPGGSTTIYRPS FQG (SEQ ID NO: 190) (Kabat); SPGGST (SEQ ID NO: 191) (Chothia) | MYTGGYGGSWY FDY (SEQ ID NO: 192) |
| 10A1 | YYYWT (SEQ ID NO: 382) (Kabat); GGSISYY (SEQ ID NO: 383) (Chothia); GGSISYYYWT (SEQ ID NO: 384) (Extended) | HIYYSGSTNYNPS LKS (SEQ ID NO: 385) (Kabat); YYSGS (SEQ ID NO: 386) (Chothia) | AEGSIDAFDF (SEQ ID NO: 387) |
| 10E2 | SNYMT (SEQ ID NO: 388) (Kabat); GFTVSSN (SEQ ID NO: 389) (Chothia); GFTVSSNYMT (SEQ ID NO: 390) (Extended) | VIYSGGSTYYADS VKG (SEQ ID NO: 391) (Kabat); YSGGS (SEQ ID NO: 392) (Chothia) | NWGDYW (SEQ ID NO: 393) |
| 11A1 | YYFWN (SEQ ID NO: 394) (Kabat); GGSIDYY (SEQ ID NO: 395) (Chothia); GGSIDYYFWN (SEQ ID NO: 396) (Extended) | HVYDIGNTKYNP SLKS (SEQ ID NO: 397) (Kabat); YDIGN (SEQ ID NO: 398) (Chothia) | GEGA1DAFDI (SEQ ID NO: 399) |
| 11C1 | YYYWT (SEQ ID NO: 400) (Kabat); GGSISYY (SEQ ID NO: 401) (Chothia); GGSISYYYWT (SEQ ID NO: 402) (Extended) | HVIYSGTTNYNPS LKS (SEQ ID NO: 403) (Kabat); IYSGT (SEQ ID NO: 404) (Chothia) | AEGS1DAFDL (SEQ ID NO: 405) |
| 11D1 | DYGIH (SEQ ID NO: 406) (Kabat); GFTFSDY (SEQ ID NO: 407) (Chothia); GFTFSDYGIH (SEQ ID NO: 408) (Extended) | VIWYDGSiKKYSD SVKG (SEQ ID NO: 409) (Kabat); WYDGSi (SEQ ID NO: 410) (Chothia) | DEVGtfGAFDF (SEQ ID NO: 411) |
| 11E1 | SdgYYWS (SEQ ID NO: 412) (Kabat); GGSISSdgY (SEQ ID NO: 413) (Chothia); GGSISSdgYYWS (SEQ ID NO: 414) (Extended) | YMYYSGSTYYNP SLKS (SEQ ID NO: 415) (Kabat); YYSGS (SEQ ID NO: 416) (Chothia) | DFGWYFDL (SEQ ID NO: 417) |
| 12A2 | SdgYYWS (SEQ ID NO: 418) (Kabat); GGSVSSdgY (SEQ ID NO: 419) (Chothia); GGSVSSdgYYWS (SEQ ID NO: 420) (Extended) | YIYYRRITDYNPS LKS (SEQ ID NO: 421) (Kabat); YYRRI (SEQ ID NO: 422) (Chothia) | DFGWYFDL (SEQ ID NO: 423) |
| 12C4 | GYYLH (SEQ ID NO: 424) (Kabat); | WINpNSGGTNYA QKFQG (SEQ ID | DRGVtmivDGMD D (SEQ ID NO: |

TABLE 2A-continued

| | Heavy Chain | | |
|---|---|---|---|
| mAb | CDRH1 | CDRH2 | CDRH3 |
| | GYTFTGY (SEQ ID NO: 425) (Chothia); GYTFTGYYLH (SEQ ID NO: 426) (Extended) | NO: 427) (Kabat); NpNSGG (SEQ ID NO: 428) (Chothia) | 429) |
| 12C5 | DYGMH (SEQ ID NO: 430) (Kabat); GFTFSDY (SEQ ID NO: 431) (Chothia); GFTFSDYGMH (SEQ ID NO: 432) (Extended) | VIWYDGSnKYYA DSVKG (SEQ ID NO: 433) (Kabat); WYDGSn (SEQ ID NO: 434) (Chothia) | DEVGfvGAFDI (SEQ ID NO: 435) |
| 12C6 | DYGMH (SEQ ID NO: 663) (Kabat); GFTFSDY (SEQ ID NO: 664) (Chothia); GFTFSDYGMH (SEQ ID NO: 665) (Extended) | VIWYDGSnKYYA DSVKG (SEQ ID NO: 666) (Kabat); WYDGSn (SEQ ID NO: 667) (Chothia) | DEVGfvGAFDI (SEQ ID NO: 668) |
| 12D3 | SdgYYWS (SEQ ID NO: 436) (Kabat); GGSISSdgY (SEQ ID NO: 437) (Chothia); GGSISSdgYYWS (SEQ ID NO: 438) (Extended) | YMYYSGITYHNP SLKS (SEQ ID NO: 439) (Kabat); YYSGI (SEQ ID NO: 440) (Chothia) | DFGWYFDL (SEQ ID NO: 441) |
| 12D6 | SdaYYWS (SEQ ID NO: 442) (Kabat); GGSISSdaY (SEQ ID NO: 443) (Chothia); GGSISSdaYYWS (SEQ ID NO: 444) (Extended) | YMYYSGITYYNP SLKS (SEQ ID NO: 445) (Kabat); YYSGI (SEQ ID NO: 446) (Chothia) | DFGWYFDL (SEQ ID NO: 447) |
| 12D7 | DYGIH (SEQ ID NO: 448) (Kabat); GFTFSDY (SEQ ID NO: 449) (Chothia); GFTFSDYGIH (SEQ ID NO: 450) (Extended) | VIWYDGSiKKYSD SVKG (SEQ ID NO: 451) (Kabat); WYDGSi (SEQ ID NO: 452) (Chothia) | DEVGtfGAFDF (SEQ ID NO: 453) |
| 12F5 | NAWMS (SEQ ID NO: 454) (Kabat); GFTFSNA (SEQ ID NO: 455) (Chothia); GFTFSNAWMS (SEQ ID NO: 456) (Extended) | RIKsktGGGTTDYA APVKG (SEQ ID NO: 457) (Kabat); KsktGGGT (SEQ ID NO: 458) (Chothia) | LIVGaiSLFDY (SEQ ID NO: 459) |
| 12H4 | YYFWT (SEQ ID NO: 460) (Kabat); GGSISYY (SEQ ID NO: 461) (Chothia); GGSISYYFWT (SEQ ID NO: 462) (Extended) | QIYYSGNTNSNPS LKS (SEQ ID NO: 463) (Kabat); YYSGN (SEQ ID NO: 464) (Chothia) | AEGSlDAFDI (SEQ ID NO: 465) |
| 8C8 | SYSMN (SEQ ID NO: 466) (Kabat); GFTFSSY (SEQ ID NO: 467) (Chothia); GFTFSSYSMN (SEQ ID NO: 468) (Extended) | SIStSSNYIHYADS LQG (SEQ ID NO: 469) (Kabat); StSSNY (SEQ ID NO: 470) (Chothia) | DKGTtltnWYFDL (SEQ ID NO: 471) |
| 8F7 | SYGMH (SEQ ID NO: 472) (Kabat); GFTFSSY (SEQ ID NO: 473) (Chothia); GFTFSSYGMH (SEQ ID NO: 474) (Extended) | VIWYDGSnKYYA DSLKG (SEQ ID NO: 475) (Kabat); WYDGSn (SEQ ID NO: 476) (Chothia) | DGYSgssDAFDI (SEQ ID NO: 477) |
| 8F8 | YYYWS (SEQ ID NO: 478) (Kabat); GGSISYY (SEQ ID NO: 479) (Chothia); GGSISYYYWS (SEQ ID NO: 480) (Extended) | NINYMGNTIYNPS LKS (SEQ ID NO: 481) (Kabat); NYMGN (SEQ ID NO: 482) (Chothia) | AEGSlDAFDF (SEQ ID NO: 483) |

TABLE 2A-continued

| | Heavy Chain | | |
|---|---|---|---|
| mAb | CDRH1 | CDRH2 | CDRH3 |
| 9D8 | GYYIY (SEQ ID NO: 484) (Kabat); GYIFTGY (SEQ ID NO: 485) (Chothia); GYIFTGYYIY (SEQ ID NO: 486) (Extended) | WINpSSGGTNYA QKFQG (SEQ ID NO: 487) (Kabat); NpSSGG (SEQ ID NO: 488) (Chothia) | DRKReyyynFGMDV (SEQ ID NO: 489) |
| 9E10 | SHYIY (SEQ ID NO: 490) (Kabat); GYTFTSH (SEQ ID NO: 491) (Chothia); GYTFTSHYIY (SEQ ID NO: 492) (Extended) | WINpNSGGTNYA QKFQD (SEQ ID NO: 493) (Kabat); NpNSGG (SEQ ID NO: 494) (Chothia) | DRKReyyynFGMDV (SEQ ID NO: 495) |
| 9E5 | SHYIY (SEQ ID NO: 496) (Kabat); GFTFTSH (SEQ ID NO: 497) (Chothia); GFTFTSHYIY (SEQ ID NO: 498) (Extended) | WINpNSGGTKYA QKFQD (SEQ ID NO: 499) (Kabat); NpNSGG (SEQ ID NO: 500) (Chothia) | DRKReyyynFGMDV (SEQ ID NO: 501) |
| 9F4 | IYAIH (SEQ ID NO: 502) (Kabat); GFTLSIY (SEQ ID NO: 503) (Chothia); GFTLSIYAIH (SEQ ID NO: 504) (Extended) | SFGgRGSSTYFAD SVKG (SEQ ID NO: 505) (Kabat); GgRGSS (SEQ ID NO: 506) (Chothia) | EKDWgRGFDY (SEQ ID NO: 507) |
| 9F8 | NYSMN (SEQ ID NO: 508) (Kabat); GFTFSNY (SEQ ID NO: 509) (Chothia); GFTFSNYSMN (SEQ ID NO: 510) (Extended) | SISsSTIYIYYADS VKG (SEQ ID NO: 511) (Kabat); SsSTIY (SEQ ID NO: 512) (Chothia) | DIGWevftLGFDY (SEQ ID NO: 513) |

TABLE 2B

| | Light Chain | | |
|---|---|---|---|
| mAb | CDRL1 | CDRL2 | CDRL3 |
| 31H1 | RSSQSLVHSDGNTYLS (SEQ ID NO: 193); | KISNRFS (SEQ ID NO: 194) | MQATQFPLT (SEQ ID NO: 195) |
| 63B2 | RSSQSLVHSDGNTYLS (SEQ ID NO: 196); | KISNRFS (SEQ ID NO: 197) | MQATQFPLT (SEQ ID NO: 198) |
| 40E3 | RASQGISNYLA (SEQ ID NO: 199); | AASSLQS (SEQ ID NO: 200) | QQYNSYPLT (SEQ ID NO: 201) |
| 42C3 | RSSQSLVYSDENTYLN (SEQ ID NO: 202); | QVSNRDS (SEQ ID NO: 203) | MQGTYWPPT (SEQ ID NO: 204) |
| 45F11 | RASQSVSSSLA (SEQ ID NO: 205); | GASTRAT (SEQ ID NO: 206) | QQYINWPH (SEQ ID NO: 207) |
| 64F9 | QASQDISNYLN (SEQ ID NO: 208); | GASNLET (SEQ ID NO: 209) | QQYDNFPIT (SEQ ID NO: 210) |
| 72C2 | RASQSVSSNLA (SEQ ID NO: 211); | SASTRAS (SEQ ID NO: 212) | QQYDNWPPLT (SEQ ID NO: 213) |
| 2F10 | RASQSVSSSYLA (SEQ ID NO: 214); | GASSRAT (SEQ ID NO: 215) | QQYGSSPLT (SEQ ID NO: 216) |
| 4F11 | RASQDISNYLA (SEQ ID NO: 217); | AASSLQS (SEQ ID NO: 218) | LQLNSFPFT (SEQ ID NO: 219) |
| 10H10 | RASQGISSWLA (SEQ ID NO: 220); | AASSLQS (SEQ ID NO: 221) | QQAFSFPFT (SEQ ID NO: 222) |

TABLE 2B-continued

| | Light Chain | | |
|---|---|---|---|
| mAb | CDRL1 | CDRL2 | CDRL3 |
| 17G6 | KSSQSVLYSYNNKNYVA (SEQ ID NO: 223); | WASTRES (SEQ ID NO: 224) | QQYYSTLT (SEQ ID NO: 225) |
| 65E11 | RASQSVSSSYLA (SEQ ID NO: 226); | DASSRAT (SEQ ID NO: 227) | QQYGSSPLT (SEQ ID NO: 228) |
| P02B10 | SGSSSNIGSNYVY (SEQ ID NO: 229); | RNNQRPS (SEQ ID NO: 230) | AAWDDSLSGVV (SEQ ID NO: 231) |
| P07D03 | SGSRSNIGSNYVY (SEQ ID NO: 232); | RNNQRPS (SEQ ID NO: 233) | ASWDGSLSAVV (SEQ ID NO: 234) |
| P08A02 | SGSSSNIGSNYVY (SEQ ID NO: 235); | RNNQRPS (SEQ ID NO: 236) | ATWDDSLGSPV (SEQ ID NO: 237) |
| P08E02 | RASQSISRYLN (SEQ ID NO: 238); | AASILQT (SEQ ID NO: 239) | QQSYSTTMWT (SEQ ID NO: 240) |
| P08F08 | SGSSSNIGSNYVN (SEQ ID NO: 241); | GDYQRPS (SEQ ID NO: 242) | ATRDDSLSGSVV (SEQ ID NO: 243) |
| P08G02 | RASQSIYDYLH (SEQ ID NO: 244); | DASNLQS (SEQ ID NO: 245) | QQSYTTPLFT (SEQ ID NO: 246) |
| P12B09 | RASQYIGRYLN (SEQ ID NO: 247); | GATSLAS (SEQ ID NO: 248) | QQSYSTTSPT (SEQ ID NO: 249) |
| P12F02 | SGSTSNIGRNYVY (SEQ ID NO: 250); | RTNQRPS (SEQ ID NO: 251) | AAWDDSLSGRV (SEQ ID NO: 252) |
| P12G07 | SGSSSNIGSNYVY (SEQ ID NO: 253); | MNNQRPS (SEQ ID NO: 254) | AAWDDSLSAVV (SEQ ID NO: 255) |
| P13F04 | SGSNSNIGTNYVS (SEQ ID NO: 256); | RSSRRPS (SEQ ID NO: 257) | AAWDGSLSGHWV (SEQ ID NO: 258) |
| P15D02 | RASQSIDTYLN (SEQ ID NO: 259); | SASSLHS (SEQ ID NO: 260) | QQSYSTTAWT (SEQ ID NO: 261) |
| P16C05 | RASQSIGQSLN (SEQ ID NO: 262); | GASSLQS (SEQ ID NO: 263) | QQSYSTPIT (SEQ ID NO: 264) |
| 10A1 | RASQSISTWLA (SEQ ID NO: 514); | KASSLES (SEQ ID NO: 515) | QQYKSYSHT (SEQ ID NO: 516) |
| 10E2 | RASQSISSWLA (SEQ ID NO: 517); | KASSLES (SEQ ID NO: 518) | QQYKSFSLT (SEQ ID NO: 519) |
| 11A1 | RASQSISSWLA (SEQ ID NO: 520); | KASTLES (SEQ ID NO: 521) | QQYNSYSYT (SEQ ID NO: 522) |
| 11C1 | RASQSVSSWLA (SEQ ID NO: 523); | KASSLES (SEQ ID NO: 524) | QQYNTYSHT (SEQ ID NO: 525) |
| 11D1 | RASQGIRNDLG (SEQ ID NO: 526); | AASSLQS (SEQ ID NO: 527) | LQDYNYPFT (SEQ ID NO: 528) |
| 11E1 | RASQDIDNYLA (SEQ ID NO: 529); | AASALQS (SEQ ID NO: 530) | QNYNSGPRT (SEQ ID NO: 531) |
| 12A2 | RASQDISNYLT (SEQ ID NO: 532); | AASALQS (SEQ ID NO: 533) | QNYNSAPRT (SEQ ID NO: 534) |
| 12C4 | RSSQSLLHSNGYNYLD (SEQ ID NO: 535); | LGSNRAS (SEQ ID NO: 536) | MQTLQTPFT (SEQ ID NO: 537) |
| 12C5 | RASQGINSHLA (SEQ ID NO: 538); | YASTLPS (SEQ ID NO: 539) | QQLNHYPIT (SEQ ID NO: 540) |
| 12C6 | RASQGINSHLA (SEQ ID NO: 669); | YASTLPS (SEQ ID NO: 670) | QQLNHYPIT (SEQ ID NO: 671) |
| 12D3 | RASQGISNYLA (SEQ ID NO: 541); | AASTLHS (SEQ ID NO: 542) | QKYNSAPRT (SEQ ID NO: 543) |

TABLE 2B-continued

Light Chain

| mAb | CDRL1 | CDRL2 | CDRL3 |
|---|---|---|---|
| 12D6 | RASQDISNYLA (SEQ ID NO: 544); | AASTLHS (SEQ ID NO: 545) | QKYNSAPRT (SEQ ID NO: 546) |
| 12D7 | RASQDISSFLA (SEQ ID NO: 547); | VASTLQS (SEQ ID NO: 548) | QQLHVYPIT (SEQ ID NO: 549) |
| 12F5 | RSSQSLLDSDDGNtYLD (SEQ ID NO: 550); | TLSYRAS (SEQ ID NO: 551) | MQRIEFPFT (SEQ ID NO: 552) |
| 12H4 | RASQTISTWLA (SEQ ID NO: 553); | KASNLES (SEQ ID NO: 554) | QQYQTFSHT (SEQ ID NO: 555) |
| 8C8 | RASQGISNYLA (SEQ ID NO: 556); | AASTLQS (SEQ ID NO: 557) | QKYNSAPLT (SEQ ID NO: 558) |
| 8F7 | RSSQTLVHSNGYNYLN (SEQ ID NO: 559); | LGSNRAS (SEQ ID NO: 560) | MQAIQTPYT (SEQ ID NO: 561) |
| 8F8 | RASQSISSWLA (SEQ ID NO: 562); | KASNLES (SEQ ID NO: 563) | QQYNSYSCT (SEQ ID NO: 564) |
| 9D8 | QASQDINNYLH (SEQ ID NO: 565); | DASDWET (SEQ ID NO: 566) | QQYDHLPIT (SEQ ID NO: 567) |
| 9E10 | QASQDISNYLH (SEQ ID NO: 568); | DASDLET (SEQ ID NO: 569) | QQYDHLPIT (SEQ ID NO: 570) |
| 9E5 | QASQDISNYLH (SEQ ID NO: 571); | DASDLET (SEQ ID NO: 572) | QQYDHLPIT (SEQ ID NO: 573) |
| 9F4 | QASQDISNYLN (SEQ ID NO: 574); | DASNLET (SEQ ID NO: 575) | QQYDNLPYT (SEQ ID NO: 576) |
| 9F8 | RSSQSLLYSNGYNYLD (SEQ ID NO: 577); | LNSNRAS (SEQ ID NO: 578) | MQALQTPLT (SEQ ID NO: 579) |

The disclosure encompasses modifications to the CARs and polypeptides comprising the sequences shown in Tables 1 or 2A-2B, including functionally equivalent CARs having modifications which do not significantly affect their properties and variants which have enhanced or decreased activity and/or affinity. For example, the amino acid sequence may be mutated to obtain an antibody with the desired binding affinity to CD70. Modification of polypeptides is routine practice in the art and need not be described in detail herein. Examples of modified polypeptides include polypeptides with conservative substitutions of amino acid residues, one or more deletions or additions of amino acids which do not significantly deleteriously change the functional activity, or which mature (enhance) the affinity of the polypeptide for its ligand, or use of chemical analogs.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include an antibody with an N-terminal methionyl residue or the antibody fused to an epitope tag. Other insertional variants of the antibody molecule include the fusion to the N- or C-terminus of the antibody of an enzyme or a polypeptide which increases the half-life of the antibody in the blood circulation.

Substitution variants have at least one amino acid residue in the antibody molecule removed and a different residue inserted in its place. The sites of greatest interest for substitutional mutagenesis include the hypervariable regions, but FR alterations are also contemplated. Conservative substitutions are shown in Table 3 under the heading of "conservative substitutions." If such substitutions result in a change in biological activity, then more substantial changes, denominated "exemplary substitutions" in Table 3, or as further described below in reference to amino acid classes, may be introduced and the products screened.

TABLE 3

Amino Acid Substitutions

| Original Residue (naturally occurring amino acid) | Conservative Substitutions | Exemplary Substitutions |
|---|---|---|
| Ala (A) | Val | Val; Leu; Ile |
| Arg (R) | Lys | Lys; Gln; Asn |
| Asn (N) | Gln | Gln; His; Asp, Lys; Arg |
| Asp (D) | Glu | Glu; Asn |
| Cys (C) | Ser | Ser; Ala |
| Gln (Q) | Asn | Asn; Glu |
| Glu (E) | Asp | Asp; Gln |
| Gly (G) | Ala | Ala |
| His (H) | Arg | Asn; Gln; Lys; Arg |
| Ile (I) | Leu | Leu; Val; Met; Ala; Phe; Norleucine |
| Leu (L) | Ile | Norleucine; Ile; Val; Met; Ala; Phe |
| Lys (K) | Arg | Arg; Gln; Asn |
| Met (M) | Leu | Leu; Phe; Ile |
| Phe (F) | Tyr | Leu; Val; Ile; Ala; Tyr |
| Pro (P) | Ala | Ala |
| Ser (S) | Thr | Thr |
| Thr (T) | Ser | Ser |

TABLE 3-continued

Amino Acid Substitutions

| Original Residue (naturally occurring amino acid) | Conservative Substitutions | Exemplary Substitutions |
| --- | --- | --- |
| Trp (W) | Tyr | Tyr; Phe |
| Tyr (Y) | Phe | Trp; Phe; Thr; Ser |
| Val (V) | Leu | Ile; Leu; Met; Phe; Ala; Norleucine |

In some embodiments, the disclosure provides a CAR comprising an extracellular ligand-binding domain that binds to CD70 and competes for binding to CD70 with a CAR described herein, including CAR comprising an extracellular domain comprising an ScFv comprising the sequences of 31H1, 63B2, 40E3, 42C3, 45F11, 64F9, 72C2, 2F10, 4F11, 10H10, 17G6, 65E11, P02B10, P07D03, P08A02, P08E02, P08F08, P08G02, P12B09, P12F02, P12G07, P13F04, P15D02, P16C05, 10A1, 10E2, 11A1, 11C1, 11D1, 11E1, 12A2, 12C4, 12C5, 12D3, 12D6, 12D7, 12F5, 12H4, 8C8, 8F7, 8F8, 9D8, 9E10, 9E5, 9F4 or 9F8.

In some embodiments, the disclosure provides a CAR, which specifically binds to CD70, wherein the CAR comprises a VH region comprising a sequence shown in SEQ ID NO: 20; and/or a VL region comprising a sequence shown in SEQ ID NO: 19. In some embodiments, the disclosure provides a CAR, which specifically binds to CD70, wherein the CAR comprises a VH region comprising a sequence shown in SEQ ID NO: 22; and/or a VL region comprising a sequence shown in SEQ ID NO: 21. In some embodiments, the disclosure provides a CAR, which specifically binds to CD70, wherein the CAR comprises a VH region comprising a sequence shown in SEQ ID NO: 28; and/or a VL region comprising a sequence shown in SEQ ID NO: 27. In some embodiments, the disclosure provides a CAR, which specifically binds to CD70, wherein the CAR comprises a VH region comprising a sequence shown in SEQ ID NO: 36; and/or a VL region comprising a sequence shown in SEQ ID NO: 35. In some embodiments, the disclosure provides a CAR, which specifically binds to CD70, wherein the CAR comprises a VH region comprising a sequence shown in SEQ ID NO: 46; and/or a VL region comprising a sequence shown in SEQ ID NO: 45. In some embodiments, the disclosure provides a CAR, which specifically binds to CD70, wherein the CAR comprises a VH region comprising a sequence shown in SEQ ID NO: 18; and/or a VL region comprising a sequence shown in SEQ ID NO: 17. In some embodiments, the disclosure provides a CAR, which specifically binds to CD70, wherein the CAR comprises a VH region comprising a sequence shown in SEQ ID NO: 34; and/or a VL region comprising a sequence shown in SEQ ID NO: 33. In some embodiments, the disclosure also provides CARs comprising CDR portions of antibodies to CD70 antibodies based on CDR contact regions. CDR contact regions are regions of an antibody that imbue specificity to the antibody for an antigen. In general, CDR contact regions include the residue positions in the CDRs and Vernier zones which are constrained in order to maintain proper loop structure for the antibody to bind a specific antigen. See, e.g., Makabe et al., J. Biol. Chem., 283:1156-1166, 2007. Determination of CDR contact regions is well within the skill of the art.

The binding affinity (KD) of the ligand binding domain of the CD70 specific CAR as described herein to CD70 (such as human CD70) can be for example about 0.1 to about 1000 nM, for example between about 0.5 nM to about 500 nM, or for example between about 1 nM to about 250 nM. In some embodiments, the binding affinity is about any of 1000 nM, 750 nm, 500 nm, 400 nm, 300 nm, 250 nm, 200 nM, 100 nM, 90 nM, 80 nM, 70 nM, 60 nM, 50 nM, 45 nM, 40 nM, 35 nM, 30 nM, 25 nM, 20 nM, 19 nm, 18 nm, 17 nm, 16 nm, 15 nM, 10 nM, 8 nM, 7.5 nM, 7 nM, 6.5 nM, 6 nM, 5.5 nM, 5 nM, 4 nM, 3 nM, 2 nM, 1 nM, 0.5 nM, 0.3 nM or 0.1 nM.

In some embodiments, the binding affinity (KD) of the scFv of the ligand binding domain of the CD70-specific CAR as described herein to CD70 is about 10 nM to about 100 nM, about 10 nM to about 90 nM, about 10 nM to about 80 nM, about 20 nM to about 70 nM, about 25 nM to about 75 nM, or about 40 nM to about 110 nM. In some embodiments, the binding affinities of the scFv described in this paragraph are for human CD70.

In some embodiments, the binding affinity is less than about any of 1000 nm, 900 nm, 800 nm, 250 nM, 200 nM, 100 nM, 50 nM, 30 nM, 20 nM, 10 nM, 7.5 nM, 7 nM, 6.5 nM, 6 nM, 5 nM.

The intracellular signaling domain of a CAR according to the disclosure is responsible for intracellular signaling following the binding of extracellular ligand-binding domain to the target resulting in the activation of the immune cell and immune response. The intracellular signaling domain has the ability to activate of at least one of the normal effector functions of the immune cell in which the CAR is expressed. For example, the effector function of a T cell can be a cytolytic activity or helper activity including the secretion of cytokines.

In some embodiments, an intracellular signaling domain for use in a CAR can be the cytoplasmic sequences of, for example without limitation, the T cell receptor and co-receptors that act in concert to initiate signal transduction following antigen receptor engagement, as well as any derivative or variant of these sequences and any synthetic sequence that has the same functional capability. Intracellular signaling domains comprise two distinct classes of cytoplasmic signaling sequences: those that initiate antigen-dependent primary activation, and those that act in an antigen-independent manner to provide a secondary or co-stimulatory signal. Primary cytoplasmic signaling sequences can comprise signaling motifs which are known as immunoreceptor tyrosine-based activation motifs of ITAMs. ITAMs are well defined signaling motifs found in the intracytoplasmic tail of a variety of receptors that serve as binding sites for syk/zap70 class tyrosine kinases. Examples of ITAM used in the disclosure can include as non limiting examples those derived from TCRζ, FcRγ, FcRβ, FcRε, CD3γ, CD3δ, CD3ε, CD5, CD22, CD79a, CD79b and CD66d. In some embodiments, the intracellular signaling domain of the CAR can comprise the CD3 signaling domain which has amino acid sequence with at least about 70%, at least 80%, at least 90%, 95%, 97%, or 99% sequence identity with an amino acid sequence shown in SEQ ID NO: 272 or 683. In some embodiments the intracellular signaling domain of the CAR of the disclosure comprises a domain of a co-stimulatory molecule.

In some embodiments, the intracellular signaling domain of a CAR of the disclosure comprises a part of co-stimulatory molecule selected from the group consisting of fragment of 41BB (GenBank: AAA53133.) and CD28 (NP_006130.1). In some embodiments, the intracellular signaling domain of the CAR of the disclosure comprises amino acid sequence which comprises at least 70%, at least 80%, at least 90%, 95%, 97%, or 99% sequence identity with an amino acid sequence shown in SEQ ID NO: 271 or 682 and SEQ ID NO: 275. In some embodiments, the intracellular signaling domain of the CAR of the disclosure comprises amino acid sequence which comprises at least 70%, at least 80%, at least 90%, 95%, 97%, or 99% sequence identity with an amino acid sequence shown in SEQ ID NO: 271 or 682 and/or at least 70%, at least 80%, at least 90%, 95%, 97%, or 99% sequence identity with an amino acid sequence shown in SEQ ID NO: 276.

CARs are expressed on the surface membrane of the cell. Thus, the CAR can comprise a transmembrane domain. Suitable transmembrane domains for a CAR disclosed herein have the ability to (a) be expressed at the surface of a cell, which is in some embodiments an immune cell such as, for example without limitation, a lymphocyte cell, such as a T helper ($T_h$) cell, cytotoxic T ($T_c$) cell, T regulatory ($T_{reg}$) cell, or Natural killer (NK) cells, and/or (b) interact with the ligand-binding domain and intracellular signaling domain for directing cellular response of an immune cell against a predefined target cell. The transmembrane domain can be derived either from a natural or from a synthetic source. The transmembrane domain can be derived from any membrane-bound or transmembrane protein. As non-limiting examples, the transmembrane polypeptide can be a subsequence or subunit of the T cell receptor such as α, β, γ or δ, polypeptide constituting CD3 complex, IL-2 receptor p55 (a chain), p75 (β chain) or γ chain, subunit chain of Fc receptors, in particular Fcγ receptor III or CD proteins. Alternatively, the transmembrane domain can be synthetic and can comprise predominantly hydrophobic residues such as leucine and valine. In some embodiments said transmembrane domain is derived from the human CD8α chain (e.g., NP_001139345.1). The transmembrane domain can further comprise a stalk domain between the extracellular ligand-binding domain and said transmembrane domain. A stalk domain may comprise up to 300 amino acids—in some embodiments 10 to 100 amino acids or in some embodiments 25 to 50 amino acids. Stalk region may be derived from all or part of naturally occurring molecules, such as from all or part of the extracellular region of CD8, CD4, CD28, 4-1BB, or IgG (in particular, the hinge region of an IgG), or from all or part of an antibody heavy-chain constant region. Alternatively the stalk domain may be a synthetic sequence that corresponds to a naturally occurring stalk sequence, or may be an entirely synthetic stalk sequence. In some embodiments said stalk domain is a part of human CD8α chain (e.g., NP_001139345.1). In another particular embodiment, said hinge and transmembrane domains comprise a part of human CD8α chain, which in some embodiments comprises at least 70%, at least 80%, at least 90%, 95% 97%, or 99% sequence identity with amino acid sequence selected from the group consisting of SEQ ID NO: 268 and 270. In some embodiments, the stalk domain of CARs described herein comprises a subsequence of CD8α, an IgG1, or an FcγRIIIα, in particular the hinge region of any of an CD8α, an IgG1, or an FcγRIIIα. In some embodiments, the stalk domain comprises a human CD8α hinge, a human IgG1 hinge, or a human FcγRIIIα hinge In some embodiments, CARs disclosed herein can comprise an extracellular ligand-binding domain that specifically binds CD70. In some embodiments the CARs disclosed herein comprise an scFv, CD8α human hinge and transmembrane domains, the CD3ζ signaling domain, and 4-1BB signaling domain.

Table 4 provides exemplary sequences of domains which can be used in the CARs disclosed herein.

TABLE 4

Exemplary sequences of CAR Components

| Domain | Amino Acid Sequence | SEQ ID NO: |
|---|---|---|
| CD8α signal peptide | MALPVTALLLPLALLLHAARP | 266 |
| FcγRIIIα hinge | GLAVSTISSFFPPGYQ | 267 |
| CD8α hinge | TTTPAPRPPTPAPTIASQPLSLRPEACRPAAGGAVHTRGLDFACD | 268 |
| IgG1 hinge | EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK | 269 |
| CD8α transmembrane (TM) domain | IYIWAPLAGTCGVLLLSLVITLYC | 270 |
| 41BB intracellular signaling domain (ISD) | KRGRKKLLYIFKQPFMRPVQTTQEEDGCSCRFPEEEEGGCEL | 271 |
| 41BB intracellular signaling domain (ISD) | GRKKLLYIFKQPFMRPVQTTQEEDGCSCRFPEEEEGGCEL | 682 |
| CD3ζ intracellular signaling domain (ISD) | RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 272 |
| CD3ζ intracellular signaling domain (ISD) | RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 683 |

TABLE 4-continued

Exemplary sequences of CAR Components

| Domain | Amino Acid Sequence | SEQ ID NO: |
|---|---|---|
| FcεRI α-TM-IC (FcεRI α chain transmembrane and intracellular domain) | FFIPLLVVILFAVDTGLFISTQQQVTFLLKIKRTRKGFRLLNP HPKPNPKNN | 273 |
| FcεRIβ-ΔITAM (FcεRI β chain without ITAM) | MDTESNRRANLALPQEPSSVPAFEVLEISPQEVSSGRLLKS ASSPPLHTWLTVLKKEQEFLGVTQILTAMICLCFGTVVCSV LDISHIEGDIFSSFKAGYPFWGAIFFSISGMLSIISERRNATYL VRGSLGANTASSIAGGTGITILIINLKKSLAYIHIHSCQKFFE TKCFMASFSTEIVVMMLFLTILGLGSAVSLTICGAGEELKG NKVPE | 274 |
| CD28-IC (CD28 co-stimulatory domain) | RSKRSRGGHSDYMNMTPRRPGPTRKHYQPYAPPRDFAAY RS | 276 |
| FcεRIγ-SP (signal peptide) | MIPAVVLLLLLLVEQAAA | 277 |
| FcεRI γ-ΔITAM (FcεRI γ chain without ITAM) | LGEPQLCYILDAILFLYGIVLTLLYCRLKIQVRKAAITSYEKS | 278 |
| GSG-P2A (GSG-P2A ribosomal skip polypeptide) | GSGATNFSLLKQAGDVEENPGP | 279 |
| GSG-T2A (GSG-T2A ribosomal skip polypeptide) | GSGEGRGSLLTCGDVEENPGP | 280 |

Downregulation or mutation of target antigens is commonly observed in cancer cells, creating antigen-loss escape variants. Thus, to offset tumor escape and render immune cell more specific to target, the CD70-specific CAR can comprise one or more additional extracellular ligand-binding domains, to simultaneously bind different elements in target thereby augmenting immune cell activation and function. In some embodiments, the extracellular ligand-binding domains can be placed in tandem on the same transmembrane polypeptide, and optionally can be separated by a linker. In some embodiments, said different extracellular ligand-binding domains can be placed on different transmembrane polypeptides composing the CAR. In some embodiments, the disclosure relates to a population of CARs, each CAR comprising a different extracellular ligand-binding domain. In particular, the disclosure relates to a method of engineering immune cells comprising providing an immune cell and expressing at the surface of the cell a population of CARs, each CAR comprising different extracellular ligand-binding domains. In another particular embodiment, the disclosure relates to a method of engineering an immune cell comprising providing an immune cell and introducing into the cell polynucleotides encoding polypeptides composing a population of CAR each one comprising different extracellular ligand-binding domains. By population of CARs, it is meant at least two, three, four, five, six or more CARs each one comprising different extracellular ligand-binding domains. The different extracellular ligand-binding domains according to the disclosure can, in some embodiments, simultaneously bind different elements in target thereby augmenting immune cell activation and function. The disclosure also relates to an isolated immune cell which comprises a population of CARs each one comprising different extracellular ligand-binding domains.

In another aspect, the disclosure provides polynucleotides encoding any of the CARs and polypeptides described herein. Polynucleotides can be made and expressed by procedures known in the art.

In another aspect, the disclosure provides compositions (such as a pharmaceutical compositions) comprising any of the cells of the disclosure. In some embodiments, the composition comprises a cell comprising a polynucleotide encoding any of the CARs described herein. In still other embodiments, the composition comprises either or both of the polynucleotides shown in SEQ ID NO: 297 and SEQ ID NO:298, SEQ ID NO: 299 and SEQ ID NO:300, SEQ ID NO: 301 and SEQ ID NO:302, SEQ ID NO: 303 and SEQ ID NO:304, SEQ ID NO: 305 and SEQ ID NO:306, SEQ ID NO: 307 and SEQ ID NO:308 or SEQ ID NO: 309 and SEQ ID NO:310, below:

4F11 heavy chain variable region
(SEQ ID NO: 297)
CAGGTCACCTTGAAGGAGTCTGGTCCTGTGCTGGTGAAACCCACAGAGAC

CCTCACGCTGACCTGCACCGTCTCTGGGTTCTCACTCAGTAATGCTAGAA

TGGGTGTGACCTGGATCCGTCAGCCCCCAGGGAAGGCCCTGGAGTGGCTT

GCACACATTTTTTCGAATGACGAAAAATCCTACAGTACATCTCTGAAGAG

CAGGCTCACCATCTCCAAGGACACTTCCAAAACCCAGGTGGTCCTTACCA

TGACCAACATGGACCCTGTGGACACAGCCACATATTACTGTGCACGGATA

CGAGATTACTATGACATTAGTAGTTATTATGACTACTGGGGCCAGGGAAC

CCTGGTCAGCGTCTCCTCA

4F11 light chain variable region
(SEQ ID NO: 298)
GACATCCAGATGACCCAGTCTCCATCTGCCATGTCTGCATCTGTAGGAGA

CAGAGTCACCATCACTTGTCGGGCGAGTCAGGACATTAGCAATTATTTAG

CCTGGTTTCAGCAGAAACCAGGGAAAGTCCCTAAGCGCCTGATCTATGCT

GCATCCAGTTTGCAAAGTGGGGTCCCATCAAGGTTCAGCGGCAGTGGATC

GGGGACAGAATTCACTCTCACAATCAGCAGCCTGCTGCCTGAAGATTTTG

CAACTTATTACTGTCTACAGCTTAATAGTTTCCCGTTCACTTTTGGCGGA

GGGACCAAGGTGGAGATCAAC

In still other embodiments, the composition comprises either or both of the polynucleotides shown in SEQ ID NO: 299 and SEQ ID NO:300 below:

17G6 heavy chain variable region
(SEQ ID NO: 299)
GAGGTGCAGCTGGTGGAGTCTGGGGGAGGCTTGGTCCAGCCTGGGGGGTC

CCTGAGACTCTCCTGTGTAGCCTCTGGATTCACCTTTAGTAGTTATTGGA

TGAGCTGGGTCCGCCAGGCTCCAGGGAAGGGGCTGGAGTGGGTGGCCAGC

ATAAAGCAAGATGGAAGTGAGAAATACTATGTGGACTCTGTGAAGGGCCG

ATTCACCATCTCCAGAGACAACGCCAAGAACTCAGTGTATCTGCAAATGA

ACAGCCTGAGAGCCGAGGACACGGGTGTGTATTACTGTGCGAGAGAAGGA

GTCAACTGGGGATGGAGACTCTACTGGCACTTCGATCTCTGGGGCCGTGG

AACCCTGGTCACTGTCTCCTCA

17G6 light chain variable region
(SEQ ID NO: 300)
GACATCGTGATGACCCAGTCTCCAGACTCCCTGGCTGTGTCTCTGGGCGA

GAGGGCCACCATCAACTGCAAGTCCAGCCAGAGTGTTTTATACAGCTACA

ACAATAAGAACTACGTAGCTTGGTACCAGCAGAAACCAGGACAACCTCCT

AACCTACTCATTTTCTGGGCATCTACCCGGGAATCCGGGGTCCCTGACCG

ATTCAGTGGCAGCGGGTCTGGGACAGATTTCACTCTCACCATCAGCAGCC

TGCAGGCTGAAGATGTGGCAGTTTACTACTGTCAGCAATATTATAGTACG

CTCACTTTCGGCGGAGGGACCAAGGTGGAGATCAAA.

In still other embodiments, the composition comprises either or both of the polynucleotides shown in SEQ ID NO: 301 and SEQ ID NO:302 below:

10H10 heavy chain variable region
(SEQ ID NO: 301)
GAGGTGCAGCTGGTGGAGTCTGGGGGAGGCTTGGTACAGCCTGGGGGGTC

CCTGAGACTCTCCTGTGCAGTCTCTGGATTCACCTTCAGTAACCATAACA

TACACTGGGTCCGCCAGGCTCCAGGGAAGGGGCTGGAGTGGATTTCATAC

ATTAGTCGAAGTAGTAGTACCATATATTACGCAGACTCTGTGAAGGGCCG

ATTCACAATCTCCAGAGACAATGCCAAGAACTCACTGTATCTGCAAATGA

ACAGCCTGAGAGACGAAGACACGGCTGTGTATTACTGTGCGAGAGATCAC

GCTCAGTGGTACGGTATGGACGTTTGGGGCCAAGGGACCACGGTCACCGT

CTCCTCA.

10H10 light chain variable region
(SEQ ID NO: 302)
GACATCCAGATGACCCAGTCTCCATCTTCCGTGTCTGCATCGGTAGGAGA

CAGAGTCACCATCACTTGTCGGGCGAGTCAGGGTATTAGCAGCTGGTTAG

CCTGGTATCAGCAGAAACCAGGGAAAGCCCCTAAGGTCCTGATCTATGCT

GCATCCAGTTTGCAAAGTGGGGTCCCATCAAGGTTCAGCGGCAGTGGATC

TGGGACAGATTTCACTCTCACCATCAGCAGCCTGCAGCCTGAAGATTTTG

CAACTTACTATTGTCAACAGGCTTTCAGTTTCCCATTCACTTTCGGCCCT

GGGACCAAAGTGGATATCAAA.

In still other embodiments, the composition comprises either or both of the polynucleotides shown in SEQ ID NO: 303 and SEQ ID NO:304 below:

P07D03 heavy chain variable region
(SEQ ID NO: 303)
GAAGTGCAGCTTGTCCAGAGCGGAGCCGAAGTGAAGAAGCCTGGCGAGAG

CCTGAAGATCAGCTGCAAGGGCTCCGGATATCGCTTCACAAGTTACTGGA

TAGGGTGGGTGCGCCAGATGCCTGGTAAGGGACTGGAATGGATGGGCTCT

ATATATCCTGATGATTCCGACACACGTTATAGCCCAAGCTTTCAGGGCCA

GGTCACAATCAGCGCTGACAAGAGCATCAGCACCGCCTACCTTCAGTGGT

CGTCTCTGAAGGCCAGCGACACCGCAATGTACTACTGCGCCTCTAGCACA

GTTGACTACCCGGGATACAGTTACTTCGACTACTGGGGCCAAGGTACACT

GGTCACCGTCAGCAGC

P07D03 light chain variable region
(SEQ ID NO: 304)
GAGCTCCAGAGCGTGCTGACCCAGCCTCCTAGCGCAAGCGGCACCCCTGG

ACAGCGTGTGACAATTAGCTGTAGCGGAAGTCGTAGCAATATCGGATCAA

ACTATGTGTATTGGTATCAGCAATTGCCCGGTACAGCACCCAAATTGCTC

ATATATAGAAATAATCAGAGACCTAGCGGAGTGCCTGATCGTTTTAGCGG

TAGCAAAAGCGGCACCAGCGCATCACTGGCAATTTCAGGCCTGCGTAGCG

AAGATGAGGCGGATTATTACTGTGCGAGTTGGGATGGTTCGCTGAGTGCT

GTTGTGTTCGGCACCGGTACAAAACTGACCGTTCTG

In still other embodiments, the composition comprises either or both of the polynucleotides shown in SEQ ID NO: 305 and SEQ ID NO:306 below:

P08G02 heavy chain variable region
(SEQ ID NO: 305)
GAAGTGCAGCTTGTCCAGAGCGGAGCCGAAGTGAAGAAGCCTGGCGAGAG

CCTGAAGATCAGCTGCAAGGGCTCCGGATACACCTTTCCTTCATCATGGA

TAGGTTGGGTGCGCCAGATGCCTGGTAAGGGACTGGAATGGATGGGCATC

ATATACCCTGATACTAGCCATACCCGTTACAGCCCAAGCTTTCAGGGCCA

GGTCACAATCAGCGCTGACAAGAGCATCAGCACCGCCTACCTTCAGTGGT

CGTCTCTGAAGGCCAGCGACACCGCAATGTACTACTGTGCCCGTGCGAGC

TATTTCGATCGTGGAACAGGGTATAGTTCTTGGTGGATGGATGTGTGGGG

CCAAGGTACACTGGTCACCGTCAGCAGC

P08G02 light chain variable region
(SEQ ID NO: 306)
GAGCTCGATATTCAGATGACCCAGAGCCCTAGCAGCCTGAGCGCAAGCGT

GGGCGATAGAGTGACCATTACCTGTAGGGCCTCACAATCCATATACGACT

ATTTGCACTGGTATCAGCAGAAACCCGGGAAAGCACCCAAACTGCTGATT

TACGATGCTTCCAACCTACAGAGTGGCGTTCCTTCACGTTTTAGCGGTAG

CGGTTCAGGCACCGATTTCACCCTGACCATTAGCAGCCTTCAGCCCGAAG

ATTTCGCTACGTATTATTGCCAGCAATCATACACCACGCCGTTGTTTACA

TTCGGCCAGGGTACCAAAGTGGAAATCAAA

In still other embodiments, the composition comprises either or both of the polynucleotides shown in SEQ ID NO: 307 and SEQ ID NO: 308 below:

P08F08 heavy chain variable region
(SEQ ID NO: 307)
GAAGTGCAGCTTGTCCAGAGCGGAGCCGAAGTGAAGAAGCCTGGCGAGAG

CCTGAAGATCAGCTGCAAGGGCTCCGGATACGGATTCACAAGTTATTGGA

TAGGTTGGGTGCGCCAGATGCCTGGTAAGGGACTGGAATGGATGGGTATC

ATTCATCCCGATGATAGCGACACCAAATACGCCCAAGCTTTCAGGGCCA

GGTCACAATCAGCGCTGACAAGAGCATCAGCACCGCCTACCTTCAGTGGT

CGTCTCTGAAGGCCAGCGACACCGCAATGTACTACTGTGCCTCTAGCTAT

TTGCGTGGCTTGTGGGGAGGCTATTTTGACTATTGGGGCCAAGGTACACT

GGTCACCGTCAGCAGC

P08F08 light chain variable region
(SEQ ID NO: 308)
GAGCTCCAGAGCGTGCTGACCCAGCCTCCTAGCGCAAGCGGCACCCCTGG

ACAGCGTGTGACAATTAGCTGTAGCGGATCAAGCTCAAACATTGGCTCAA

ATTATGTGAATTGGTATCAGCAATTGCCCGGTACAGCACCCAAACTGCTC

ATTTATGGAGATTATCAACGACCTAGCGGAGTGCCTGATCGTTTTAGCGG

TAGCAAAAGCGGCACCAGCGCATCACTGGCAATTTCAGGCCTGCGTAGCG

AAGATGAGGCGGATTATTACTGTGCTACCCGCGACGATTCGTTATCTGGG

TCTGTCGTTTTTGGCACCGGTACAAAACTGACCGTGCTG

In still other embodiments, the composition comprises either or both of the polynucleotides shown in SEQ ID NO: 309 and SEQ ID NO:310 below:

P15D02 heavy chain variable region
(SEQ ID NO: 309)
GAAGTGCAGCTTGTCCAGAGCGGAGCCGAAGTGAAGAAGCCTGGCGAGAG

CCTGAAGATCAGCTGCAAGGGCTCCGGATACAGTTTTGCCTCATACTGGA

TCGGTTGGGTGCGCCAGATGCCTGGTAAGGGACTGGAATGGATGGGCGTA

ATTTACCCCGGAACTAGCGAGACACGTTACAGCCCAAGCTTTCAGGGCCA

GGTCACAATCAGCGCTGACAAGAGCATCAGCACCGCCTACCTTCAGTGGT

CGTCTCTGAAGGCCAGCGACACCGCAATGTACTACTGCGCTAAAGGGTTG

AGTGCGAGTGCAAGTGGATATTCTTTCCAATATTGGGGCCAAGGTACACT

GGTCACCGTCAGCAGC

P15D032 light chain variable region
(SEQ ID NO: 310)
GAGCTCGATATTCAGATGACCCAGAGCCCTAGCAGCCTGAGCGCAAGCGT

GGGCGATAGAGTGACCATTACCTGTAGGGCCTCACAAAGCATCGACACAT

ATTTAAACTGGTATCAGCAGAAACCCGGGAAAGCACCCAAACTGCTGATT

TATTCAGCTAGTAGCCTACACAGTGGCGTTCCTTCACGTTTTAGCGGTAG

CGGTTCAGGCACCGATTTCACCCTGACCATTAGCAGCCTTCAGCCCGAAG

ATTTCGCTACGTATTATTGCCAACAATCATACAGCACAACTGCTTGGACA

TTCGGCCAGGGTACCAAAGTGGAAATCAAA

Expression vectors, and administration of polynucleotide compositions are further described herein.

In another aspect, the disclosure provides a method of making any of the polynucleotides described herein.

Polynucleotides complementary to any such sequences are also encompassed by the disclosure. Polynucleotides may be single-stranded (coding or antisense) or double-stranded, and may be DNA (genomic, cDNA or synthetic) or RNA molecules. RNA molecules include HnRNA molecules, which contain introns and correspond to a DNA molecule in a one-to-one manner, and mRNA molecules, which do not contain introns. Additional coding or non-coding sequences may, but need not, be present within a polynucleotide of the disclosure, and a polynucleotide may, but need not, be linked to other molecules and/or support materials.

Polynucleotides may comprise a native sequence (i.e., an endogenous sequence that encodes an antibody or a portion thereof) or may comprise a variant of such a sequence. Polynucleotide variants contain one or more substitutions, additions, deletions and/or insertions such that the immunoreactivity of the encoded polypeptide is not diminished, relative to a native immunoreactive molecule. The effect on the immunoreactivity of the encoded polypeptide may generally be assessed as described herein. Variants embodiments exhibit at least about 70% identity, at least about 80% identity, at least about 90% identity, or at least about 95% identity to a polynucleotide sequence that encodes a native antibody or a portion thereof.

Two polynucleotide or polypeptide sequences are said to be "identical" if the sequence of nucleotides or amino acids in the two sequences is the same when aligned for maximum correspondence as described below. Comparisons between two sequences are typically performed by comparing the sequences over a comparison window to identify and compare local regions of sequence similarity. A "comparison window" as used herein, refers to a segment of at least about 20 contiguous positions, usually 30 to about 75, or 40 to about 50, in which a sequence may be compared to a reference sequence of the same number of contiguous positions after the two sequences are optimally aligned.

Optimal alignment of sequences for comparison may be conducted using the Megalign program in the Lasergene suite of bioinformatics software (DNASTAR, Inc., Madison, Wis.), using default parameters. This program embodies several alignment schemes described in the following references: Dayhoff, M. O., 1978, A model of evolutionary change in proteins—Matrices for detecting distant relationships. In Dayhoff, M. O. (ed.) Atlas of Protein Sequence and Structure, National Biomedical Research Foundation, Washington D.C. Vol. 5, Suppl. 3, pp. 345-358; Hein J., 1990, Unified Approach to Alignment and Phylogenes pp. 626-645 Methods in Enzymology vol. 183, Academic Press, Inc., San Diego, Calif.; Higgins, D. G. and Sharp, P. M., 1989, CABIOS 5:151-153; Myers, E. W. and Muller W., 1988, CABIOS 4:11-17; Robinson, E. D., 1971, Comb. Theor. 11:105; Santou, N., Nes, M., 1987, Mol. Biol. Evol. 4:406-425; Sneath, P. H. A. and Sokal, R. R., 1973, Numerical Taxonomy the Principles and Practice of Numerical Taxonomy, Freeman Press, San Francisco, Calif.; Wilbur, W. J. and Lipman, D. J., 1983, Proc. Natl. Acad. Sci. USA 80:726-730.

The "percentage of sequence identity" is determined by comparing two optimally aligned sequences over a window of comparison of at least 20 positions, wherein the portion of the polynucleotide or polypeptide sequence in the comparison window may comprise additions or deletions (i.e., gaps) of 20 percent or less, usually 5 to 15 percent, or 10 to 12 percent, as compared to the reference sequences (which does not comprise additions or deletions) for optimal alignment of the two sequences. The percentage is calculated by determining the number of positions at which the identical nucleic acid bases or amino acid residue occurs in both sequences to yield the number of matched positions, dividing the number of matched positions by the total number of positions in the reference sequence (i.e. the window size) and multiplying the results by 100 to yield the percentage of sequence identity.

Variants may also, or alternatively, be substantially homologous to a native gene, or a portion or complement thereof. Such polynucleotide variants are capable of hybridizing under moderately stringent conditions to a naturally occurring DNA sequence encoding a native antibody (or a complementary sequence).

Suitable "moderately stringent conditions" include prewashing in a solution of 5×SSC, 0.5% SDS, 1.0 mM EDTA (pH 8.0); hybridizing at 50° C.–65° C., 5×SSC, overnight; followed by washing twice at 65° C. for 20 minutes with each of 2×, 0.5× and 0.2×SSC containing 0.1% SDS.

As used herein, "highly stringent conditions" or "high stringency conditions" are those that: (1) employ low ionic strength and high temperature for washing, for example 0.015 M sodium chloride/0.0015 M sodium citrate/0.1% sodium dodecyl sulfate at 50° C.; (2) employ during hybridization a denaturing agent, such as formamide, for example, 50% (v/v) formamide with 0.1% bovine serum albumin/0.1% Ficoll/0.1% polyvinylpyrrolidone/50 mM sodium phosphate buffer at pH 6.5 with 750 mM sodium chloride, 75 mM sodium citrate at 42° C.; or (3) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 μg/ml), 0.1% SDS, and 10% dextran sulfate at 42° C., with washes at 42° C. in 0.2×SSC (sodium chloride/sodium citrate) and 50% formamide at 55° C., followed by a high-stringency wash consisting of 0.1×SSC containing EDTA at 55° C. The skilled artisan will recognize how to adjust the temperature, ionic strength, etc. as necessary to accommodate factors such as probe length and the like.

It will be appreciated by those of ordinary skill in the art that, as a result of the degeneracy of the genetic code, there are many nucleotide sequences that encode a polypeptide as described herein. Some of these polynucleotides bear minimal homology to the nucleotide sequence of any native gene. Nonetheless, polynucleotides that vary due to differences in codon usage are specifically contemplated by the disclosure. Further, alleles of the genes comprising the polynucleotide sequences provided herein are within the scope of the disclosure. Alleles are endogenous genes that are altered as a result of one or more mutations, such as deletions, additions and/or substitutions of nucleotides. The resulting mRNA and protein may, but need not, have an altered structure or function. Alleles may be identified using standard techniques (such as hybridization, amplification and/or database sequence comparison).

The polynucleotides of this disclosure can be obtained using chemical synthesis, recombinant methods, or PCR. Methods of chemical polynucleotide synthesis are well known in the art and need not be described in detail herein. One of skill in the art can use the sequences provided herein and a commercial DNA synthesizer to produce a desired DNA sequence.

For preparing polynucleotides using recombinant methods, a polynucleotide comprising a desired sequence can be inserted into a suitable vector, and the vector in turn can be introduced into a suitable host cell for replication and amplification, as further discussed herein. Polynucleotides may be inserted into host cells by any means known in the art. Cells are transformed by introducing an exogenous polynucleotide by direct uptake, endocytosis, transfection, F-mating or electroporation. Once introduced, the exogenous polynucleotide can be maintained within the cell as a non-integrated vector (such as a plasmid) or integrated into the host cell genome. The polynucleotide so amplified can be isolated from the host cell by methods well known within the art. See, e.g., Sambrook et al., 1989.

Alternatively, PCR allows reproduction of DNA sequences. PCR technology is well known in the art and is described in U.S. Pat. Nos. 4,683,195, 4,800,159, 4,754,065 and 4,683,202, as well as PCR: The Polymerase Chain Reaction, Mullis et al. eds., Birkauswer Press, Boston, 1994.

RNA can be obtained by using the isolated DNA in an appropriate vector and inserting it into a suitable host cell. When the cell replicates and the DNA is transcribed into RNA, the RNA can then be isolated using methods well known to those of skill in the art, as set forth in Sambrook et al., 1989, supra, for example.

Suitable cloning vectors may be constructed according to standard techniques, or may be selected from a large number of cloning vectors available in the art. While the cloning vector selected may vary according to the host cell intended to be used, useful cloning vectors will generally have the ability to self-replicate, may possess a single target for a particular restriction endonuclease, and/or may carry genes for a marker that can be used in selecting clones containing the vector. Suitable examples include plasmids and bacterial viruses, e.g., pUC18, pUC19, Bluescript (e.g., pBS SK+) and its derivatives, mp18, mp19, pBR322, pMB9, ColE1, pCR1, RP4, phage DNAs, and shuttle vectors such as pSA3 and pAT28. These and many other cloning vectors are available from commercial vendors such as BioRad, Stratagene, and Invitrogen.

Expression vectors generally are replicable polynucleotide constructs that contain a polynucleotide according to the disclosure. It is implied that an expression vector must be replicable in the host cells either as episomes or as an integral part of the chromosomal DNA. Suitable expression vectors include but are not limited to plasmids, viral vectors, including adenoviruses, adeno-associated viruses, retroviruses, cosmids, and expression vector(s) disclosed in PCT Publication No. WO87/04462, or the lentiviral pLVX vector available from Clonetech. Vector components may generally include, but are not limited to, one or more of the following: a signal sequence; an origin of replication; one or more marker genes; suitable transcriptional controlling elements (such as promoters, enhancers and terminator). For expression (i.e., translation), one or more translational controlling elements are also usually required, such as ribosome binding sites, translation initiation sites, and stop codons.

The vectors containing the polynucleotides of interest can be introduced into the host cell by any of a number of appropriate means, including electroporation, transfection employing calcium chloride, rubidium chloride, calcium phosphate, DEAE-dextran, or other substances; microprojectile bombardment; lipofection; and infection (e.g., where the vector is an infectious agent such as vaccinia virus). The choice of introducing vectors or polynucleotides will often depend on features of the host cell.

A polynucleotide encoding a CD70-specific CAR disclosed herein may exist in an expression cassette or expression vector (e.g., a plasmid for introduction into a bacterial host cell, or a viral vector such as a baculovirus vector for transfection of an insect host cell, or a plasmid or viral vector such as a lentivirus for transfection of a mammalian host cell). In some embodiments, a polynucleotide or vector can include a nucleic acid sequence encoding ribosomal skip sequences such as, for example without limitation, a sequence encoding a 2A peptide. 2A peptides, which were identified in the Aphthovirus subgroup of picornaviruses, causes a ribosomal "skip" from one codon to the next without the formation of a peptide bond between the two amino acids encoded by the codons (see (Donnelly and Elliott 2001; Atkins, Wills et al. 2007; Doronina, Wu et al. 2008)). By "codon" is meant three nucleotides on an mRNA (or on the sense strand of a DNA molecule) that are translated by a ribosome into one amino acid residue. Thus, two polypeptides can be synthesized from a single, contiguous open reading frame within an mRNA when the polypeptides are separated by a 2A oligopeptide sequence that is in frame. Such ribosomal skip mechanisms are well known in the art and are known to be used by several vectors for the expression of several proteins encoded by a single messenger RNA.

To direct transmembrane polypeptides into the secretory pathway of a host cell, in some embodiments, a secretory signal sequence (also known as a leader sequence, prepro sequence or pre sequence) is provided in a polynucleotide sequence or vector sequence. The secretory signal sequence is operably linked to the transmembrane nucleic acid sequence, i.e., the two sequences are joined in the correct reading frame and positioned to direct the newly synthesized polypeptide into the secretory pathway of the host cell. Secretory signal sequences are commonly positioned 5' to the nucleic acid sequence encoding the polypeptide of interest, although certain secretory signal sequences may be positioned elsewhere in the nucleic acid sequence of interest (see, e.g., Welch et al., U.S. Pat. No. 5,037,743; Holland et al., U.S. Pat. No. 5,143,830). In some embodiments the signal peptide comprises the amino acid sequence shown in SEQ ID NO: 266 or 277. Those skilled in the art will recognize that, in view of the degeneracy of the genetic code, considerable sequence variation is possible among these polynucleotide molecules. In some embodiments, nucleic acid sequences of the disclosure are codon-optimized for expression in mammalian cells, or in some embodiments for expression in human cells. Codon-optimization refers to the exchange in a sequence of interest of codons that are generally rare in highly expressed genes of a given species by codons that are generally frequent in highly expressed genes of such species, such codons encoding the amino acids as the codons that are being exchanged.

CD70-Specific Antibodies and Methods of Making Thereof
Provided herein are CD70 antibodies.

In some embodiments, a CD70 antibody of the disclosure comprises any one of the partial light chain sequence as listed in Table 1 and/or any one of the partial heavy chain sequence as listed in Table 1. In Table 1, the underlined sequences are CDR sequences according to Kabat and in bold according to Chothia.

Tables 2A-2B provide examples of CDR sequences of the CD70 antibodies provided herein.

In some embodiments, the disclosure provides an antibody (e.g. including antibody fragments, such as single chain variable fragments (scFvs) which specifically binds to Cluster of Differentiation 70 (CD70), wherein the antibody comprises (a) a heavy chain variable (VH) region comprising (i) a VH complementarity determining region one (CDR1) comprising the sequence shown in SEQ ID NO: 49, 50, 51, 55, 56, 57, 61, 62, 63, 67, 68, 69, 73, 74, 75, 79, 80, 81, 85, 86, 87, 91, 92, 93, 97, 98, 99, 103, 104, 105, 109, 110, 111, 115, 116, 117, 121, 122, 123, 127, 128, 129, 133, 134, 135, 139, 140, 141, 145, 146, 147, 151, 152, 153, 157, 158, 159, 163, 164, 165, 169, 170, 171, 175, 176, 177, 181, 182, 183, 187, 188, 189, 382, 383, 384, 388, 389, 390, 394, 395, 396, 400, 401, 402, 406, 407, 408, 412, 413, 414, 418, 419, 420, 424, 425, 426, 430, 431, 432, 663, 664, 665, 436, 437, 438, 442, 443, 444, 448, 449, 450, 454, 455, 456, 460, 461, 462, 466, 467, 468, 472, 473, 474, 478, 479, 480, 484, 485, 486, 490, 491, 492, 496, 497, 498, 502, 503, 504, 508, 509, or 510; (ii) a VH CDR2 comprising the sequence shown in SEQ ID NO: 52, 53, 58, 59, 64, 65, 70, 71, 76, 77, 82, 83, 88, 89, 94, 95, 100, 101, 106, 107, 112, 113, 118, 119, 124, 125, 130, 131, 136, 137, 142, 143, 148, 149, 154, 155, 160, 161, 166, 167, 172, 173, 178, 179, 184, 185, 190, 191, 385, 386, 391, 392, 397, 398, 403, 404, 409, 410, 415, 416, 421, 422, 427, 428, 433, 434, 666, 667, 439, 440, 445, 446, 451, 452, 457, 458, 463, 464, 469, 470, 475, 476, 481, 482, 487, 488, 493, 494, 499, 500, 505, 506, 511, or 512; and iii) a VH CDR3 comprising the sequence shown in SEQ ID NO: 54, 60, 66, 72, 78, 84, 90, 96, 102, 108, 114, 120, 126, 132, 138, 144, 150, 156, 162, 168, 174, 180, 186, 192, 387, 393, 399, 405, 411, 417, 423, 429, 435, 668, 441, 447, 453, 459, 465, 471, 477, 483, 489, 495, 501, 507, or 513; and/or a light chain variable (VL) region comprising (i) a VL CDR1 comprising the sequence shown in SEQ ID NO: 193, 196, 199, 202, 205, 208, 211, 214, 217, 220, 223, 226, 229, 232, 235, 238, 241, 244, 247, 250, 253, 256, 259, 262, 514, 517, 520, 523, 526, 529, 532, 535, 538, 669, 541, 544, 547, 550, 553, 556, 559, 562, 565, 568, 571, 574, or 577; (ii) a VL CDR2 comprising the sequence shown in SEQ ID NO: 194, 197, 200, 203, 206, 209, 212, 215, 218, 221, 224, 227, 230, 233, 236, 239, 242, 245, 248, 251, 254, 257, 260, 263, 515, 518, 521, 524, 527, 530, 533, 536, 539, 670, 542, 545, 548, 551, 554, 557, 560, 563, 566, 569, 572, 575, or 578; and (iii) a VL CDR3 comprising the sequence shown in SEQ ID NO: 195, 198, 201, 204, 207, 210, 213, 216, 219, 222, 225, 228, 231, 234, 237, 240, 243, 246, 249, 252, 255, 258, 261, 264, 516, 519, 522, 525, 528, 531, 534, 537, 540, 671, 543, 546, 549, 552, 555, 558, 561, 564, 567, 570, 573, 576, or 579.

In some embodiments, the disclosure provides an antibody (e.g. a scFv), which specifically binds to Cluster of Differentiation 70 (CD70), wherein the antibody comprises a heavy chain variable (VH) region comprising a VH CDR1, VH CDR2, and VH CDR3 of the VH sequence shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 662, 357, 359, 361, 363, 365, 367, 369, 371, 373, 375, 377, 379, or 381; and/or a light chain variable (VL) region comprising VL CDR1, VL CDR2, and VL CDR3 of the VL sequence shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 661, 356, 358, 360, 362, 364, 366, 368, 370, 372, 374, 376, 378, or 380.

In some embodiments, the disclosure provides an isolated antibody which specifically binds to CD70 and competes with any of the foregoing antibodies.

In some embodiments, the present invention provides an antibody that binds to CD70 and competes with an antibody as described herein, including 31H1, 63B2, 40E3, 42C3, 45F11, 64F9, 72C2, 2F10, 4F11, 10H10, 17G6, 65E11, P02B10, P07D03, P08A02, P08E02, P08F08, P08G02, P12B09, P12F02, P12G07, P13F04, P15D02, P16C05, 10A1, 10E2, 11A1, 11C1, 11D1, 11E1, 12A2, 12C4, 12C5, 12D3, 12D6, 12D7, 12F5, 12H4, 8C8, 8F7, 8F8, 9D8, 9E10, 9E5, 9F4 or 9F8.

In some embodiments, the invention also provides CDR portions of antibodies to CD70 antibodies based on CDR contact regions. CDR contact regions are regions of an antibody that imbue specificity to the antibody for an antigen. In general, CDR contact regions include the residue positions in the CDRs and Vernier zones which are constrained in order to maintain proper loop structure for the antibody to bind a specific antigen. See, e.g., Makabe et al., J. Biol. Chem., 283:1156-1166, 2007. Determination of CDR contact regions is well within the skill of the art.

The binding affinity (KD) of the CD70 antibody as described herein to CD70 (such as human CD70 (e.g., (SEQ ID NO: 335)) can be about 0.001 to about 5000 nM. In some embodiments, the binding affinity is about any of 5000 nM, 4500 nM, 4000 nM, 3500 nM, 3000 nM, 2500 nM, 2000 nM, 1789 nM, 1583 nM, 1540 nM, 1500 nM, 1490 nM, 1064 nM, 1000 nM, 933 nM, 894 nM, 750 nM, 705 nM, 678 nM, 532 nM, 500 nM, 494 nM, 400 nM, 349 nM, 340 nM, 353 nM, 300 nM, 250 nM, 244 nM, 231 nM, 225 nM, 207 nM, 200 nM, 186 nM, 172 nM, 136 nM, 113 nM, 104 nM, 101 nM, 100 nM, 90 nM, 83 nM, 79 nM, 74 nM, 54 nM, 50 nM, 45 nM, 42 nM, 40 nM, 35 nM, 32 nM, 30 nM, 25 nM, 24 nM, 22 nM, 20 nM, 19 nM, 18 nM, 17 nM, 16 nM, 15 nM, 12 nM, 10 nM, 9 nM, 8 nM, 7.5 nM, 7 nM, 6.5 nM, 6 nM, 5.5 nM, 5 nM, 4 nM, 3 nM, 2 nM, 1 nM, 0.5 nM, 0.3 nM, 0.1 nM, 0.01 nM, or 0.001 nM. In some embodiments, the binding affinity is less than about any of 5000 nM, 4000 nM, 3000 nM, 2000 nM, 1000 nM, 900 nM, 800 nM, 250 nM, 200 nM, 100 nM, 50 nM, 30 nM, 20 nM, 10 nM, 7.5 nM, 7 nM, 6.5 nM, 6 nM, 5 nM, 4.5 nM, 4 nM, 3.5 nM, 3 nM, 2.5 nM, 2 nM, 1.5 nM, 1 nM, or 0.5 nM.

In some embodiments, the disclosure provides a nucleic acid encoding any of the foregoing isolated antibodies. In some embodiments, the disclosure provides a vector comprising such a nucleic acid. In some embodiments, the disclosure provides a host cell comprising such a nucleic acid.

The disclosure further provides any of the antibodies of the foregoing antibodies for use as a medicament. In some embodiments, the medicament is for us in treatment of a CD70-related cancer selected from the group consisting of Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

In some embodiments, the disclosure provides a method of treating a subject in need thereof, comprising providing any of the foregoing antibodies, and administering said antibody to said subject.

In some embodiments, the disclosure provides a pharmaceutical composition comprising any of the foregoing antibodies.

In some embodiments, the disclosure provides a method of treating a condition associated with malignant cells expressing CD70 in a subject comprising administering to a subject in need thereof an effective amount of any one of the foregoing antibodies or a pharmaceutical composition comprising any one of the foregoing antibodies. In some embodiments, the condition is cancer. In some embodiments, the cancer is an CD70 related cancer selected from the group consisting of Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

In some embodiments, the disclosure provides, a method of inhibiting tumor growth or progression in a subject who has malignant cells expressing CD70, comprising administering to the subject in need thereof an effective amount of a pharmaceutical composition of the disclosure to the subject.

In some embodiments, the disclosure provides, a method of inhibiting metastasis of malignant cells expressing CD70 in a subject, comprising administering to the subject in need thereof an effective amount of a pharmaceutical composition of the disclosure to the subject.

In some embodiments, the disclosure provides, a method of inducing tumor regression in a subject who has malignant cells expressing CD70, comprising administering to the subject in need thereof an effective amount of a pharmaceutical composition of the disclosure to the subject.

In some embodiments, the antibody, comprising culturing the host cell of the disclosure under conditions that result in production of the antibody, and isolating the antibody from the host cell or culture.

The antibodies useful in the present invention can encompass monoclonal antibodies, polyclonal antibodies, antibody fragments (e.g., Fab, Fab', F(ab')2, Fv, Fc, etc.), chimeric antibodies, bispecific antibodies, heteroconjugate antibodies, single chain (ScFv), mutants thereof, fusion proteins comprising an antibody portion (e.g., a domain antibody), humanized antibodies, and any other modified configuration of the immunoglobulin molecule that comprises an antigen recognition site of the required specificity, including glycosylation variants of antibodies, amino acid sequence variants of antibodies, and covalently modified antibodies. The antibodies may be murine, rat, human, or any other origin (including chimeric or humanized antibodies).

In some embodiments, the CD70 monospecific antibody as described herein is a monoclonal antibody. For example, the CD70 monospecific antibody is a human monoclonal antibody.

The disclosure further provides the following illustrative embodiments:

1. An isolated antibody, which specifically binds to Cluster of Differentiation 70 (CD70), wherein the antibody comprises
   (a) a heavy chain variable (VH) region comprising (i) a VH complementarity determining region one (CDR1) comprising the sequence shown in SEQ ID NO: 49, 50, 51, 55, 56, 57, 61, 62, 63, 67, 68, 69, 73, 74, 75, 79, 80, 81, 85, 86, 87, 91, 92, 93, 97, 98, 99, 103, 104, 105, 109, 110, 111, 115, 116, 117, 121, 122, 123, 127, 128, 129, 133, 134, 135, 139, 140, 141, 145, 146, 147, 151, 152, 153, 157, 158, 159, 163, 164, 165, 169, 170, 171, 175, 176, 177, 181, 182, 183, 187, 188, 189, 382, 383, 384, 388, 389, 390, 394, 395, 396, 400, 401, 402, 406, 407, 408, 412, 413, 414, 418, 419, 420, 424, 425, 426, 430, 431, 432, 663, 664, 665, 436, 437, 438, 442, 443, 444, 448, 449, 450, 454, 455, 456, 460, 461, 462, 466, 467, 468, 472, 473, 474, 478, 479, 480, 484, 485, 486, 490, 491, 492, 496, 497, 498, 502, 503, 504, 508, 509, or 510; (ii) a VH CDR2 comprising the sequence shown in SEQ ID NO: 52, 53, 58, 59, 64, 65, 70, 71, 76, 77, 82, 83, 88, 89, 94, 95, 100, 101, 106, 107, 112, 113, 118, 119, 124, 125, 130, 131, 136, 137, 142, 143, 148, 149, 154, 155, 160, 161, 166, 167, 172, 173, 178, 179, 184, 185, 190, 191, 385, 386, 391, 392, 397, 398, 403, 404, 409, 410, 415, 416, 421, 422, 427, 428, 433, 434, 666, 667, 439, 440, 445, 446, 451, 452, 457, 458, 463, 464, 469, 470, 475, 476, 481, 482, 487, 488, 493, 494, 499, 500, 505, 506, 511, or 512; and iii) a VH CDR3 comprising the sequence shown in SEQ ID NO: 54, 60, 66, 72, 78, 84, 90, 96, 102, 108, 114, 120, 126, 132, 138, 144, 150, 156, 162, 168, 174, 180, 186, 192, 387, 393, 399, 405, 411, 417, 423, 429, 435, 668, 441, 447, 453, 459, 465, 471, 477, 483, 489, 495, 501, 507, or 513; and/or (b) a light chain variable (VL) region comprising (i) a VL CDR1 comprising the sequence shown in SEQ ID NO: 193, 196, 199, 202, 205, 208, 211, 214, 217, 220, 223, 226, 229, 232, 235, 238, 241, 244, 247, 250, 253, 256, 259, 262, 514, 517, 520, 523, 526, 529, 532, 535, 538, 669, 541, 544, 547, 550, 553, 556, 559, 562, 565, 568, 571, 574, or 577; (ii) a VL CDR2 comprising the sequence shown in SEQ ID NO: 194, 197, 200, 203, 206, 209, 212, 215, 218, 221, 224, 227, 230, 233, 236, 239, 242, 245, 248, 251, 254, 257, 260, 263, 515, 518, 521, 524, 527, 530, 533, 536, 539, 670, 542, 545, 548, 551, 554, 557, 560, 563, 566, 569, 572, 575, or 578; and (iii) a VL CDR3 comprising the sequence shown in SEQ ID NO: 195, 198, 201, 204, 207, 210, 213, 216, 219, 222, 225, 228, 231, 234, 237, 240, 243, 246, 249, 252, 255, 258, 261, 264, 516, 519, 522, 525, 528, 531, 534, 537, 540, 671, 543, 546, 549, 552, 555, 558, 561, 564, 567, 570, 573, 576, or 579.

2. An isolated antibody which specifically binds to Cluster of Differentiation 70 (CD70), wherein the antibody comprises:
(a) a VH region comprising a VH CDR1, VH CDR2, and VH CDR3 of the VH sequence shown in SEQ ID NO: 2, 4, 6, 8, 10, 12, 14, 16, 18, 20, 22, 24, 26, 28, 30, 32, 34, 36, 38, 40, 42, 44, 46, 48, 339, 341, 343, 345, 347, 349, 351, 353, 355, 662, 357, 359, 361, 363, 365, 367, 369, 371, 373, 375, 377, 379, or 381; and/or
(b) a VL region comprising VL CDR1, VL CDR2, and VL CDR3 of the VL sequence shown in SEQ ID NO: 1, 3, 5, 7, 9, 11, 13, 15, 17, 19, 21, 23, 25, 27, 29, 31, 33, 35, 37, 39, 41, 43, 45, 47, 338, 340, 342, 344, 346, 348, 350, 352, 354, 661, 356, 358, 360, 362, 364, 366, 368, 370, 372, 374, 376, 378, or 380.

3. An isolated antibody which specifically binds to CD70 and competes with the antibody of embodiment 1.

4. A nucleic acid encoding the antibody of any one of embodiments 1-3.

5. A vector comprising the nucleic acid of embodiment 4.

6. A host cell comprising the nucleic acid of embodiment 4.

7. The antibody of any one of embodiments 1-3 for use as a medicament.

8. The antibody of embodiment 7, wherein the medicament is for use in treatment of an CD70 related cancer selecting from the group consisting of Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

9. A method of treating a subject in need thereof comprising:
a. providing the antibody according to any one of embodiments 1-3; and
b. administering said antibody to said subject.

10. A pharmaceutical composition comprising the antibody of any one of embodiments 1-3.

11. A method of treating a condition associated with malignant cells expressing CD70 in a subject comprising administering to a subject in need thereof an effective amount of the antibody of any one of embodiments 1-3 or the pharmaceutical composition of embodiment 10.

12. The method of embodiment 11, wherein the condition is a cancer.

13. The method of embodiment 12, wherein the cancer is an CD70 related cancer selected from the group consisting of Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

14. A method of inhibiting tumor growth or progression in a subject who has malignant cells expressing CD70, comprising administering to the subject in need thereof an effective amount of the pharmaceutical composition of embodiment 10 to the subject.

15. A method of inhibiting metastasis of malignant cells expressing CD70 in a subject, comprising administering to the subject in need thereof an effective amount of the pharmaceutical composition of embodiment 10 to the subject.

16. A method of inducing tumor regression in a subject who has malignant cells expressing CD70, comprising administering to the subject in need thereof an effective amount of the pharmaceutical composition of embodiment 10 to the subject.

17. A method of producing an antibody, comprising culturing the host cell of embodiment 6 under conditions that result in production of the antibody, and isolating the antibody from the host cell or culture.

Methods of Engineering an Immune Cell

Methods of preparing immune cells for use in immunotherapy are provided herein. In some embodiments, the methods comprise introducing a CAR according to the disclosure into immune cells, and expanding the cells. In some embodiments, the disclosure relates to a method of engineering an immune cell comprising: providing a cell and expressing at the surface of the cell at least one CAR as described above. Methods for engineering immune cells are described in, for example, PCT Patent Application Publication Nos. WO/2014/039523, WO/2014/184741, WO/2014/191128, WO/2014/184744, and WO/2014/184143, each of which is incorporated herein by reference in its entirety. In some embodiments, the method comprises: transfecting the cell with at least one polynucleotide encoding CAR as described above, and expressing the polynucleotides in the cell.

In some embodiments, the polynucleotides are present in lentiviral vectors for stable expression in the cells.

In some embodiments, the method can further comprise a step of genetically modifying a cell by disrupting or inactivating at least one gene expressing, for example without limitation, a component of the TCR, a target for an immunosuppressive agent, an HLA gene, CD70 and/or an immune checkpoint protein such as, for example, PDCD1 or CTLA-4. By disrupting or inactivating a gene it is intended that the gene of interest is not expressed in a functional protein form. In some embodiments, the gene to be disrupted or inactivated is selected from the group consisting of, for example without limitation, TCRα, TCRβ, CD52, GR, PD-1, CD70 and CTLA-4. In some embodiments the method comprises disrupting or inactivating one or more genes by introducing into the cells a rare-cutting endonuclease able to selectively inactivate a gene by selective DNA cleavage. In some embodiments the rare-cutting endonuclease can be, for example, a zinc finger nuclease (ZFN), megaTAL nuclease, meganuclease, transcription activator-like effector nuclease (TALE-nuclease), or CRISPR-associated endonuclease.

In some embodiments, an additional catalytic domain is used with a rare-cutting endonuclease to enhance its capacity to inactivate targeted genes. For example, an additional catalytic domain can be a DNA end-processing enzyme. Non-limiting examples of DNA end-processing enzymes include 5-3' exonucleases, 3-5' exonucleases, 5-3' alkaline exonucleases, 5' flap endonucleases, helicases, hosphatase, hydrolases and template-independent DNA polymerases. Non-limiting examples of such catalytic domain comprise of a protein domain or catalytically active derivate of the protein domain selected from the group consisting of hExoI (EXO1_HUMAN), Yeast ExoI (EXO1_YEAST), E. coli ExoI, Human TREX2, Mouse TREX1, Human TREX1, Bovine TREX1, Rat TREX1, TdT (terminal deoxynucleotidyl transferase) Human DNA2, Yeast DNA2 (DNA2_YEAST). In some embodiments, an additional catalytic domain can have a 3'-5'-exonuclease activity, and In some embodiments, said additional catalytic domain is TREX, such as a TREX2 catalytic domain (WO2012/058458). In some embodiments, said catalytic domain is encoded by a single chain TREX polypeptide. The additional catalytic domain may be fused to a nuclease fusion protein or chimeric protein. In some embodiments, the additional catalytic domain is fused using, for example, a peptide linker.

In some embodiments, the method further comprises a step of introducing into cells an exogeneous nucleic acid comprising at least a sequence homologous to a portion of the target nucleic acid sequence, such that homologous recombination occurs between the target nucleic acid sequence and the exogeneous nucleic acid. In some embodiments, said exogenous nucleic acid comprises first and second portions which are homologous to region 5' and 3' of the target nucleic acid sequence, respectively. The exogenous nucleic acid may also comprise a third portion positioned between the first and the second portion which comprises no homology with the regions 5' and 3' of the target nucleic acid sequence. Following cleavage of the target nucleic acid sequence, a homologous recombination event is stimulated between the target nucleic acid sequence and the exogenous nucleic acid. In some embodiments, homologous sequences of at least about 50 bp, greater than about 100 bp, or greater than about 200 bp can be used within the donor matrix. The exogenous nucleic acid can be, for example without limitation, from about 200 bp to about 6000 bp, or from about 1000 bp to about 2000 bp. Shared nucleic acid homologies are located in regions flanking upstream and downstream the site of the break, and the nucleic acid sequence to be introduced is located between the two arms.

In some embodiments, a nucleic acid successively comprises a first region of homology to sequences upstream of said cleavage; a sequence to inactivate a targeted gene selected from the group consisting of TCRα, TCRβ, CD52, CD70, glucocorticoid receptor (GR), deoxycytidine kinase (DCK), and an immune checkpoint protein such as for example programmed death-1 (PD-1); and a second region of homology to sequences downstream of the cleavage. The polynucleotide introduction step can be simultaneous, before or after the introduction or expression of the rare-cutting endonuclease. Depending on the location of the target nucleic acid sequence wherein break event has occurred, such exogenous nucleic acid can be used to knock-out a gene, e.g. when exogenous nucleic acid is located within the open reading frame of the gene, or to introduce new sequences or genes of interest. Sequence insertions by using such exogenous nucleic acid can be used to modify a targeted existing gene, by correction or replacement of the gene (allele swap as a non-limiting example), or to up- or down-regulate the expression of the targeted gene (promoter swap as non-limiting example), the targeted gene correction or replacement. In some embodiments, inactivation of a gene selected from the group consisting of TCRα, TCRβ, CD52, CD70, GR, DCK, and immune checkpoint proteins, can be done at a precise genomic location targeted by a specific TALE-nuclease, wherein said specific TALE-nuclease catalyzes a cleavage and wherein the exogenous nucleic acid successively comprising at least a region of homology and a sequence to inactivate one targeted gene selected from the group consisting of TCRα, TCRβ, CD52, CD70, GR, DCK, immune checkpoint proteins which is integrated by homologous recombination. In some embodiments, several genes can be, successively or at the same time, disrupted or inactivated by using several TALE-nucleases respectively and specifically targeting one defined gene and several specific polynucleotides for specific gene inactivation.

In some embodiments, the method comprises inactivation of one or more additional genes selected from the group consisting of TCRα, TCRβ, CD52, CD70, GR, DCK, and immune checkpoint proteins. In some embodiments, inactivation of a gene can be accomplished by introducing into the cells at least one rare-cutting endonuclease such that the rare-cutting endonuclease specifically catalyzes cleavage in a targeted sequence of the cell genome; and optionally, introducing into the cells an exogenous nucleic acid successively comprising a first region of homology to sequences upstream of the cleavage, a sequence to be inserted in the genome of the cell, and a second region of homology to sequences downstream of the cleavage; wherein the introduced exogenous nucleic acid inactivates a gene and integrates at least one exogenous polynucleotide sequence encoding at least one recombinant protein of interest. In some embodiments, the exogenous polynucleotide sequence is integrated within a gene encoding a protein selected from the group consisting of TCRα, TCRβ, CD52, CD70, GR, DCK, and immune checkpoint protein.

In another aspect, a step of genetically modifying cells can comprise: modifying T cells by disrupting or inactivating at least one gene expressing a target for an immunosuppressive agent, and; expanding the cells, optionally in presence of the immunosuppressive agent. An immunosuppressive agent is an agent that suppresses immune function by one of several mechanisms of action. An immunosuppressive agent can diminish the extent and/or voracity of an immune response. Non-limiting examples of immunosuppressive agents include calcineurin inhibitors, targets of rapamycin, interleukin-2α-chain blockers, inhibitors of inosine monophosphate dehydrogenase, inhibitors of dihydrofolic acid reductase, corticosteroids, and immunosuppressive antimetabolites. Some cytotoxic immunosuppressants act by inhibiting DNA synthesis. Others may act through activation of T cells or by inhibiting the activation of helper cells. The methods according to the disclosure allow conferring immunosuppressive resistance to T cells for immunotherapy by disrupting or inactivating the target of the immunosuppressive agent in T cells. As non-limiting examples, targets for immunosuppressive agent can be a receptor for an immunosuppressive agent such as for example without limitation CD52, glucocorticoid receptor (GR), FKBP family gene members, and cyclophilin family gene members.

In some embodiments, the genetic modification of the method involves expression, in provided cells to engineer, of one rare-cutting endonuclease such that the rare-cutting endonuclease specifically catalyzes cleavage in one targeted gene, thereby disrupting or inactivating the targeted gene. In some embodiments, a method of engineering cells comprises at least one of the following steps: providing a T cell, such as from a cell culture or from a blood sample; selecting a gene in the T cell expressing a target for an immunosuppressive agent; introducing into the T cell a rare-cutting endonuclease able to selectively inactivate by DNA cleavage (in some embodiments by double-strand break) the gene encoding a target for the immunosuppressive agent, and expanding the cells, optionally in presence of the immunosuppressive agent.

In some embodiments, the method comprises: providing a T cell, such as from a cell culture or from a blood sample; selecting a gene in the T cell wherein the gene expresses a target for an immunosuppressive agent; transfecting the T cell with nucleic acid encoding a rare-cutting endonuclease able to selectively inactivate by DNA cleavage (in some embodiments by double-strand break) the gene encoding a target for the immunosuppressive agent, and expressing the rare-cutting endonucleases into the T cells; and expanding the cells, optionally in presence of the immunosuppressive agent.

In some embodiments, the rare-cutting endonuclease specifically targets CD52 or GR. In some embodiments, the gene selected for inactivation encodes CD52, and the immunosuppressive treatment comprises a humanized antibody targeting CD52 antigen. In some embodiments, the gene selected for inactivation encodes GR, and the immunosuppressive treatment comprises a corticosteroid such as dexamethasone. In some embodiments, the gene selected for inactivation is a FKBP family gene member or a variant thereof and the immunosuppressive treatment comprises FK506, also known as Tacrolimus or fujimycin. In some embodiments, the FKBP family gene member is FKBP12 or a variant thereof. In some embodiments, gene selected for inactivation is a cyclophilin family gene member or a variant thereof and the immunosuppressive treatment comprises cyclosporine.

In some embodiments, the rare-cutting endonuclease can be, for example, zinc finger nuclease (ZFN), megaTAL nuclease, meganuclease, transcription activator-like effector nuclease (TALE-nuclease), or CRISPR-associated endonuclease. In some embodiments, the rare-cutting endonuclease is a TALE-nuclease. In some embodiments, the rare-cutting nuclease is a CRISPR nuclease, with a guide RNA at least partially complementary or fully complementary to a target site.

Generally, a CRISPR-associated nuclease is supplied with a guide RNA (gRNA) or the functional equivalent. The gRNA is comprised of two parts; a crispr-RNA (crRNA) that is specific for a target genomic DNA sequence, and a trans-activating RNA (tracrRNA) that facilitates Cas binding to the DNA. In some embodiments, the crRNA and tracrRNA may be present in the same RNA oligonucleotide, referred to as a single guide-RNA (sgRNA). In some embodiments, the crRNA and tracrRNA may be present as separate RNA oligonucleotides. As used herein, the term "guide RNA" or "gRNA" refers to the combination of a tracrRNA and a crRNA, present as either an sgRNA or a crRNA:tracrRNA duplex. In some embodiments, the CRISPR-associated nuclease is a Cas9 nuclease. In some embodiments, the Cas9 protein can be derived from *Streptococcus pyogenes* (SpCas9). In some embodiments, the Cas9 protein can be derived from other bacteria strains including *Staphylococcus aureus* (SaCas9). In some embodiments, the Cas endonuclease is selected from the group comprising SpCas9, SpCas9-HF1, SpCas9-HF2, SpCas9-HF3, SpCas9-HF4, SaCas9, FnCpf, FnCas9, eSpCas9, C2C1, C2C3, Cpf1, Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, or Csf4.

Studies suggest that adoptive transfer of T cells derived from less-differentiated (i.e., $T_{SCM}$ or $T_{CM}$) subset leads to prolonged persistence in vivo (see, e.g., Berger, C. et al., The Journal of Clinical Investigation, 118(1): 294-305 (2008)). Thus, genetic knockdown of CD70 in the CAR T product is an important consideration to prevent T cell differentiation.

In some embodiments, the genetic modification of the method involves expression, in provided cells to engineer, of one rare-cutting endonuclease such that the rare-cutting endonuclease specifically catalyzes cleavage in th CD70 gene, thereby disrupting or inactivating the the CD70 gene. In some embodiments, a method of engineering cells comprises at least one of the following steps: providing a T cell, such as from a cell culture or from a blood sample; introducing into the T cell a rare-cutting endonuclease able to selectively inactivate by DNA cleavage (in some embodiments by double-strand break) the gene encoding CD70, and expanding the cells.

In some embodiments, the method comprises: providing a T cell, such as from a cell culture or from a blood sample; transfecting the T cell with nucleic acid encoding a rare-cutting endonuclease able to selectively inactivate by DNA cleavage (in some embodiments by double-strand break) the gene encoding CD70, and expressing the rare-cutting endonucleases into the T cells; and expanding the cells.

In some embodiments, the rare-cutting endonuclease can be, for example, a meganuclease, a zinc finger nuclease, or a TALE-nuclease (TALEN). In some embodiments, the rare-cutting endonuclease is a TALE-nuclease. In some embodiments, the rare-cutting nuclease is a CRISPR-associated nuclease, with a guide RNA at least partially complementary or fully complementary to a target site.

Also provided herein are methods of engineering T cells, suitable for immunotherapy, wherein the methods comprise: genetically modifying T cells by disrupting or inactivating at least immune checkpoint protein. In some embodiments the immune checkpoint protein is, for example, PD-1 and/or CTLA-4. In some embodiments, methods of genetically modifying a cell comprise: modifying T cells by disrupting or inactivating at least one immune checkpoint protein; and expanding the cells. Immune checkpoint proteins include, but are not limited to Programmed Death 1 (PD-1, also known as PDCD1 or CD279, accession number: NM_005018), Cytotoxic T-Lymphocyte Antigen 4 (CTLA-4, also known as CD152, GenBank accession number AF414120.1), LAG3 (also known as CD223, accession number: NM_002286.5), Tim3 (also known as HAVCR2, GenBank accession number: JX049979.1), BTLA (also known as CD272, accession number: NM-181780.3), BY55 (also known as CD160, GenBank accession number: CR541888.1), TIGIT (also known as VSTM3, accession number: NM_173799), B7H5 (also known as C10orf54, homolog of mouse vista gene, accession number: NM-022153.1), LAIR1 (also known as CD305, GenBank accession number: CR542051.1), SIGLEC10 (GeneBank accession number: AY358337.1), 2B4 (also known as CD244, accession number: NM_001166664.1), which directly inhibit immune cells. For example, CTLA-4 is a cell-surface protein expressed on certain CD4 and CD8 T cells; when engaged by its ligands (B7-1 and B7-2) on antigen presenting cells, T cell activation and effector function are inhibited.

In some embodiments, said method to engineer cells comprises at least one of the following steps: providing a T cell, such as from a cell culture or from a blood sample; introducing into the T cell a rare-cutting endonuclease able to selectively inactivate by DNA cleavage (in some embodiments by double-strand break) one gene encoding a immune checkpoint protein; and expanding the cells. In some embodiments, the method comprises: providing a T cell, such as from a cell culture or from a blood sample; transfecting said T cell with nucleic acid encoding a rare-cutting endonuclease able to selectively inactivate by DNA cleavage (in some embodiments by double-strand break) a gene encoding a immune checkpoint protein; expressing the rare-cutting endonucleases into the T cells; expanding the cells. In some embodiments, the rare-cutting endonuclease specifically targets a gene selected from the group consisting of: PD-1, CTLA-4, LAG3, Tim3, BTLA, BY55, TIGIT, B7H5, LAIR1, SIGLEC10, 2B4, TCRα, and TCRβ. In some embodiments, the rare-cutting endonuclease can be a meganuclease, a zinc finger nuclease or a TALE-nuclease. In some embodiments, the rare-cutting endonuclease is a TALE-nuclease. In some embodiments, the rare-cutting nuclease is a Cas9 nuclease, with a guide RNA at least partially complementary or fully complementary to a target site.

In some embodiments, the present disclosure can be particularly suitable for allogeneic immunotherapy. In such embodiments, cells may be modified by a method comprising: disrupting or inactivating at least one gene encoding a component of the T cell receptor (TCR) in T cells; and expanding the T cells. In some embodiments, the genetic modification of the method relies on the expression, in provided cells to engineer, of one rare-cutting endonuclease such that the rare-cutting endonuclease specifically catalyzes cleavage in one targeted gene thereby disrupting or inactivating the targeted gene. In some embodiments, said method to engineer cells comprises at least one of the following steps: providing a T cell, such as from a cell culture or from a blood sample; introducing into the T cell a rare-cutting endonuclease able to selectively inactivate by DNA cleavage (in some embodiments by double-strand break) at least one gene encoding a component of the T cell receptor (TCR), and expanding the cells.

In some embodiments, the method comprises: providing a T cell, such as from a cell culture or from a blood sample; transfecting said T cell with nucleic acid encoding a rare-cutting endonuclease able to selectively inactivate by DNA cleavage (in some embodiments by double-strand break) at least one gene encoding a component of the T cell receptor (TCR); expressing the rare-cutting endonucleases into the T cells; sorting the transformed T cells, which do not express TCR on their cell surface; and expanding the cells.

In some embodiments, the rare-cutting endonuclease can be a meganuclease, a zinc finger nucleasec or a TALE-nuclease. In some embodiments, the rare-cutting endonuclease is a TALE-nuclease. In some embodiments the TALE-nucleases recognize and cleave a sequence encoding TCRα or TCRβ. In some embodiments a TALE-nuclease comprises a polypeptide sequence selected from the amino acid sequence shown in SEQ ID NO: 281, 282, 283, 284, 285, 286, 287, 288, 289 or 290.

TALE-Nuclease Polypeptide Sequences:

```
Repeat TRAC_T01-L
                                        (SEQ ID NO: 281)
LTPQQVVAIASNGGGKQALETVQRLLPVLCQAHGLTPQQVVAIASNNGGK

QALETVQRLLPVLCQAHGLTPQQVVAIASNGGGKQALETVQRLLPVLCQA

HGLTPEQVVAIASHDGGKQALETVQRLLPVLCQAHGLTPEQVVAIASHDG

GKQALETVQRLLPVLCQAHGLTPEQVVAIASHDGGKQALETVQRLLPVLC

QAHGLTPEQVVAIASNIGGKQALETVQALLPVLCQAHGLTPEQVVAIASH

DGGKQALETVQRLLPVLCQAHGLTPEQVVAIASNIGGKQALETVQALLPV

LCQAHGLTPQQVVAIASNNGGKQALETVQRLLPVLCQAHGLTPEQVVAIA

SNIGGKQALETVQALLPVLCQAHGLTPQQVVAIASNGGGKQALETVQRLL

PVLCQAHGLTPEQVVAIASNIGGKQALETVQALLPVLCQAHGLTPQQVVA

IASNGGGKQALETVQRLLPVLCQAHGLTPEQVVAIASHDGGKQALETVQR

LLPVLCQAHGLTPQQVVAIASNGGGRPALE.

Repeat TRAC_T01-R
                                        (SEQ ID NO: 282)
LTPEQVVAIASHDGGKQALETVQRLLPVLCQAHGLTPQQVVAIASNGGGK

QALETVQRLLPVLCQAHGLTPEQVVAIASHDGGKQALETVQRLLPVLCQA

HGLTPEQVVAIASNIGGKQALETVQALLPVLCQAHGLTPQQVVAIASNNG

GKQALETVQRLLPVLCQAHGLTPEQVVAIASHDGGKQALETVQRLLPVLC

QAHGLTPQQVVAIASNGGGKQALETVQRLLPVLCQAHGLTPQQVVAIASN

NGGKQALETVQRLLPVLCQAHGLTPQQVVAIASNNGGKQALETVQRLLPV

LCQAHGLTPQQVVAIASNGGGKQALETVQRLLPVLCQAHGLTPEQVVAIA

SNIGGKQALETVQALLPVLCQAHGLTPEQVVAIASHDGGKQALETVQRLL

PVLCQAHGLTPEQVVAIASNIGGKQALETVQALLPVLCQAHGLTPEQVVA

IASHDGGKQALETVQRLLPVLCQAHGLTPQQVVAIASNNGGKQALETVQR

LLPVLCQAHGLTPQQVVAIASNGGGRPALE.
```

Repeat TRBC_T01-L (SEQ ID NO: 283)
LTPQQVVAIASNNGGKQALETVQRLLPVLCQAHGLTPQQVVAIASNGGGK

QALETVQRLLPVLCQAHGLTPQQVVAIASNNGGKQALETVQRLLPVLCQA

HGLTPQQVVAIASNGGGKQALETVQRLLPVLCQAHGLTPQQVVAIASNGG

GKQALETVQRLLPVLCQAHGLTPQQVVAIASNGGGKQALETVQRLLPVLC

QAHGLTPQQVVAIASNNGGKQALETVQRLLPVLCQAHGLTPEQVVAIASN

IGGKQALETVQALLPVLCQAHGLTPQQVVAIASNNGGKQALETVQRLLPV

LCQAHGLTPEQVVAIASHDGGKQALETVQRLLPVLCQAHGLTPEQVVAIA

SHDGGKQALETVQRLLPVLCQAHGLTPEQVVAIASNIGGKQALETVQALL

PVLCQAHGLTPQQVVAIASNGGGKQALETVQRLLPVLCQAHGLTPEQVVA

IASHDGGKQALETVQRLLPVLCQAHGLTPEQVVAIASNIGGKQALETVQA

LLPVLCQAHGLTPQQVVAIASNGGGRPALE.

Repeat TRBC_T01-R (SEQ ID NO: 284)
NPQRSTVWYLTPQQVVAIASNNGGKQALETVQRLLPVLCQAHGLTPQQVV

AIASNGGGKQALETVQRLLPVLCQAHGLTPQQVVAIASNNGGKQALETVQ

RLLPVLCQAHGLTPQQVVAIASNNGGKQALETVQRLLPVLCQAHGLTPEQ

VVAIASHDGGKQALETVQRLLPVLCQAHGLTPEQVVAIASHDGGKQALET

VQRLLPVLCQAHGLTPQQVVAIASNGGGKQALETVQRLLPVLCQAHGLTP

QQVVAIASNGGGKQALETVQRLLPVLCQAHGLTPQQVVAIASNGGGKQAL

ETVQRLLPVLCQAHGLTPQQVVAIASNGGGKQALETVQRLLPVLCQAHGL

TPQQVVAIASNNGGKQALETVQRLLPVLCQAHGLTPQQVVAIASNNGGKQ

ALETVQRLLPVLCQAHGLTPQQVVAIASNNGGKQALETVQRLLPVLCQAH

GLTPQQVVAIASNGGGKQALETVQRLLPVLCQAHGLTPQQVVAIASNNGG

KQALETVQRLLPVLCQAHGLTPQQVVAIASNGGGRPALE.

Repeat TRBC_T02-L (SEQ ID NO: 285)
LTPEQVVAIASHDGGKQALETVQRLLPVLCQAHGLTPEQVVAIASHDGGK

QALETVQRLLPVLCQAHGLTPEQVVAIASHDGGKQALETVQRLLPVLCQA

HGLTPEQVVAIASNIGGKQALETVQALLPVLCQAHGLTPEQVVAIASHDG

GKQALETVQRLLPVLCQAHGLTPEQVVAIASHDGGKQALETVQRLLPVLC

QAHGLTPEQVVAIASHDGGKQALETVQRLLPVLCQAHGLTPQQVVAIASN

NGGKQALETVQRLLPVLCQAHGLTPEQVVAIASNIGGKQALETVQALLPV

LCQAHGLTPQQVVAIASNNGGKQALETVQRLLPVLCQAHGLTPQQVVAIA

SNGGGKQALETVQRLLPVLCQAHGLTPQQVVAIASNGGGKQALETVQRLL

PVLCQAHGLTPEQVVAIASHDGGKQALETVQRLLPVLCQAHGLTPQQVVA

IASNNGGKQALETVQRLLPVLCQAHGLTPEQVVAIASHDGGKQALETVQR

LLPVLCQAHGLTPQQVVAIASNGGGRPALE.

Repeat TRBC_T02-R (SEQ ID NO: 286)
LTPQQVVAIASNNGGKQALETVQRLLPVLCQAHGLTPQQVVAIASNNGGK

QALETVQRLLPVLCQAHGLTPQQVVAIASNNGGKQALETVQRLLPVLCQA

HGLTPEQVVAIASNIGGKQALETVQALLPVLCQAHGLTPQQVVAIASNNG

GKQALETVQRLLPVLCQAHGLTPEQVVAIASNIGGKQALETVQALLPVLC

QAHGLTPQQVVAIASNGGGKQALETVQRLLPVLCQAHGLTPEQVVAIASH

DGGKQALETVQRLLPVLCQAHGLTPQQVVAIASNGGGKQALETVQRLLPV

LCQAHGLTPEQVVAIASHDGGKQALETVQRLLPVLCQAHGLTPQQVVAIA

SNGGGKQALETVQRLLPVLCQAHGLTPQQVVAIASNNGGKQALETVQRLL

PVLCQAHGLTPEQVVAIASHDGGKQALETVQRLLPVLCQAHGLTPQQVVA

IASNGGGKQALETVQRLLPVLCQAHGLTPQQVVAIASNGGGKQALETVQR

LLPVLCQAHGLTPQQVVAIASNGGGRPALE.

Repeat CD52_T02-L (SEQ ID NO: 287)
LTPQQVVAIASNGGGKQALETVQRLLPVLCQAHGLTPEQVVAIASHDGGK

QALETVQRLLPVLCQAHGLTPEQVVAIASHDGGKQALETVQRLLPVLCQA

HGLTPQQVVAIASNGGGKQALETVQRLLPVLCQAHGLTPEQVVAIASHDG

GKQALETVQRLLPVLCQAHGLTPEQVVAIASHDGGKQALETVQRLLPVLC

QAHGLTPQQVVAIASNGGGKQALETVQRLLPVLCQAHGLTPEQVVAIASN

IGGKQALETVQALLPVLCQAHGLTPEQVVAIASHDGGKQALETVQRLLPV

LCQAHGLTPQQVVAIASNGGGKQALETVQRLLPVLCQAHGLTPEQVVAIA

SHDGGKQALETVQRLLPVLCQAHGLTPEQVVAIASNIGGKQALETVQALL

PVLCQAHGLTPEQVVAIASHDGGKQALETVQRLLPVLCQAHGLTPEQVVA

IASHDGGKQALETVQRLLPVLCQAHGLTPEQVVAIASNIGGKQALETVQA

LLPVLCQAHGLTPQQVVAIASNGGGRPALE.

Repeat CD52_T02-R (SEQ ID NO: 288)
LTPQQVVAIASNGGGKQALETVQRLLPVLCQAHGLTPQQVVAIASNNGGK

QALETVQRLLPVLCQAHGLTPEQVVAIASHDGGKQALETVQRLLPVLCQA

HGLTPQQVVAIASNGGGKQALETVQRLLPVLCQAHGLTPEQVVAIASHDG

GKQALETVQRLLPVLCQAHGLTPQQVVAIASNGGGKQALETVQRLLPVLC

QAHGLTPQQVVAIASNGGGKQALETVQRLLPVLCQAHGLTPEQVVAIASN

IGGKQALETVQALLPVLCQAHGLTPEQVVAIASHDGGKQALETVQRLLPV

LCQAHGLTPEQVVAIASHDGGKQALETVQRLLPVLCQAHGLTPQQVVAIA

SNGGGKQALETVQRLLPVLCQAHGLTPQQVVAIASNNGGKQALETVQRLL

PVLCQAHGLTPQQVVAIASNGGGKQALETVQRLLPVLCQAHGLTPEQVVA

IASNIGGKQALETVQALLPVLCQAHGLTPEQVVAIASHDGGKQALETVQR

LLPVLCQAHGLTPQQVVAIASNGGGRPALE.

Repeat CD70-L (SEQ ID NO: 289)
LTPQQVVAIASNNGGKQALETVQRLLPVLCQAHGLTPQQVVAIASNNGGK

QALETVQRLLPVLCQAHGLTPQQVVAIASNGGGKQALETVQRLLPVLCQA

HGLTPEQVVAIASHDGGKQALETVQRLLPVLCQAHGLTPQQVVAIASNGG

GKQALETVQRLLPVLCQAHGLTPQQVVAIASNGGGKQALETVQRLLPVLC

QAHGLTPQQVVAIASNGGGKQALETVQRLLPVLCQAHGLTPQQVVAIASN

GGGKQALETVQRLLPVLCQAHGLTPEQVVAIASHDGGKQALETVQRLLPV

LCQAHGLTPQQVVAIASNGGGKQALETVQRLLPVLCQAHGLTPQQVVAIA

SNGGGKQALETVQRLLPVLCQAHGLTPEQVVAIASHDGGKQALETVQRLL

```
PVLCQAHGLTPEQVVAIASHDGGKQALETVQRLLPVLCQAHGLTPEQVVA

IASNIGGKQALETVQALLPVLCQAHGLTPQQVVAIASNNGGKQALETVQR

LLPVLCQAHGLTPQQVVAIASNGGGRPALE

Repeat CD70-R
                                           (SEQ ID NO: 290)
LTPQQVVAIASNNGGKQALETVQRLLPVLCQAHGLTPQQVVAIASNGGGK

QALETVQRLLPVLCQAHGLTPQQVVAIASNNGGKQALETVQRLLPVLCQA

HGLTPQQVVAIASNGGGKQALETVQRLLPVLCQAHGLTPQQVVAIASNNG

GKQALETVQRLLPVLCQAHGLTPEQVVAIASNIGGKQALETVQALLPVLC

QAHGLTPQQVVAIASNGGGKQALETVQRLLPVLCQAHGLTPQQVVAIASN

GGGKQALETVQRLLPVLCQAHGLTPEQVVAIASHDGGKQALETVQRLLPV

LCQAHGLTPEQVVAIASNIGGKQALETVQALLPVLCQAHGLTPQQVVAIA

SNNGGKQALETVQRLLPVLCQAHGLTPEQVVAIASHDGGKQALETVQRLL

PVLCQAHGLTPQQVVAIASNGGGKQALETVQRLLPVLCQAHGLTPQQVVA

IASNNGGKQALETVQRLLPVLCQAHGLTPEQVVAIASHDGGKQALETVQR

LLPVLCQAHGLTPQQVVAIASNGGGRPALE
```

In another aspect, one another step of genetically modifying cell can be a method of expanding TCRα deficient T cells comprising introducing into the T cell pTα (also known as preTCRα) or a functional variant thereof and expanding the cells, optionally through stimulation of the CD3 complex. In some embodiments, the method comprises: a) transfecting the cells with nucleic acid encoding at least a fragment of pTα to support CD3 surface expression; b) expressing said pTα into the cells; and c) expanding the cells, optionally through stimulation of the CD3 complex.

Also provided are methods of preparing T cells for immunotherapy comprising steps of the method for expansion for T cell. In some embodiments, the pTα polynucleotide sequence can be introduced randomly or by homologous recombination. In some embodiments, the insertion can be associated with the inactivation of the TCRα gene.

Different functional variants of pTα can be used. A "functional variant" of the peptide refers to a molecule substantially similar to either the entire peptide or a fragment thereof. A "fragment" of the pTα or functional variant thereof refers to any subset of the molecule, that is, a shorter peptide than the full-length pTα. In some embodiments, pTα or functional variants can be, for example, full-length pTα or a C-terminal truncated pTα version. C-terminal truncated pTα lacks in C-terminal end one or more residues. As non limiting examples, C-terminal truncated pTα version lacks 18, 48, 62, 78, 92, 110 or 114 residues from the C-terminus of the protein. Amino acid sequence variants of the peptide can be prepared by mutations in the DNA which encodes the peptide. Such functional variants include, for example, deletions from, or insertions or substitutions of, residues within the amino acid sequence. Any combination of deletion, insertion, and substitution may also be made to arrive at the final construct, provided that the final construct possesses the desired activity, in particular the restoration of a functional CD3 complex. In some embodiments, at least one mutation is introduced in the different pTα versions as described above to affect dimerization. As non limiting example, mutated residue can be at least W46R, D22A, K24A, R102A or R117A of the human pTα protein or aligned positions using CLUSTALW method on pTα family or homologue member. In some embodiments, pTα or variant thereof as described above comprise the mutated residue W46R or the mutated residues D22A, K24A, R102A and R117A. In some embodiments, said pTα or variants are also fused to a signal-transducing domain such as CD28, OX40, ICOS, CD27, CD137 (4-1BB) and CD8 as non limiting examples. The extracellular domain of pTα or variants as described above can be fused to a fragment of the TCRα protein, particularly the transmembrane and intracellular domain of TCRα. pTα variants can also be fused to the intracellular domain of TCRα.

In some embodiments, pTα versions can be fused to an extracellular ligand-binding domain. In some embodiments, pTα or functional variant thereof is fused to a single chain antibody fragment (scFv) comprising the light and the heavy variable fragment of a target antigen specific monoclonal antibody joined by a flexible linker.

The term "TCRα deficient T cell" refers to an isolated T cell that lacks expression of a functional TCRα chain. This may be accomplished by different means, as non limiting examples, by engineering a T cell such that it does not express any functional TCRα on its cell surface or by engineering a T cell such that it produces very little functional TCRα chain on its surface or by engineering a T cell to express mutated or truncated form of TCRα chain. TCRα deficient cells can no longer be expanded through CD3 complex. Thus, to overcome this problem and to allow proliferation of TCRα deficient cells, pTα or functional variant thereof is introduced into the cells, thus restoring a functional CD3 complex. In some embodiments, the method further comprises introducing into said T cells rare-cutting endonucleases able to selectively inactivate by DNA cleavage one gene encoding one component of the T cell receptor (TCR). In some embodiments, the rare-cutting endonuclease is a TALE-nuclease.

In another aspect, engineered T cells obtained by the methods described herein can be contacted with bispecific antibodies. For example, the T cells can be contacted with bispecific antibodies ex vivo prior to administration to a patient, or in vivo following administration to a patient. Bispecific antibodies comprise two variable regions with distinct antigen properties that facilitate bringing the engineered cells into proximity to a target antigen. As a non-limiting example, a bispecific antibody can be directed against a tumor marker and lymphocyte antigen, such as for example without limitation CD3, and has the potential to redirect and activate any circulating T cells against tumors.

In some embodiments, polynucleotides encoding polypeptides according to the present disclosure can be mRNA which is introduced directly into the cells, for example by electroporation. In some embodiments, cytoPulse technology can be used to transiently permeabilize living cells for delivery of material into the cells. Parameters can be modified in order to determine conditions for high transfection efficiency with minimal mortality.

Also provided herein are methods of transfecting T cell. In some embodiments, the method comprises: contacting a T cell with RNA and applying to T cell an agile pulse sequence consisting of: (a) an electrical pulse with a voltage range from about 2250 to 3000 V per centimeter; (b) a pulse width of 0.1 ms; (c) a pulse interval of about 0.2 to 10 ms between the electrical pulses of step (a) and (b); (d) an electrical pulse with a voltage range from about 2250 to 3000 V with a pulse width of about 100 ms and a pulse interval of about 100 ms between the electrical pulse of step (b) and the first electrical pulse of step (c); and (e) four electrical pulses with a voltage of about 325 V with a pulse width of about 0.2 ms and a pulse interval of 2 ms between each of 4 electrical pulses. In some embodiments, a method of transfecting T cell comprising contacting said T cell with RNA and applying to T cell an agile pulse sequence comprising: (a) an electrical pulse with a voltage of about 2250, 2300, 2350, 2400, 2450, 2500, 2550, 2400, 2450, 2500, 2600, 2700, 2800, 2900 or 3000V per centimeter; (b) a pulse width of 0.1 ms; (c) and a pulse interval of about 0.2, 0.5, 1, 2, 3, 4, 5, 6, 7, 8, 9 or 10 ms between the electrical pulses of step (a) and (b); (d) one electrical pulse with a voltage range from about 2250, of 2250, 2300, 2350, 2400, 2450, 2500, 2550, 2400, 2450, 2500, 2600, 2700, 2800, 2900 or 3000V with a pulse width of 100 ms and a pulse interval of 100 ms between the electrical pulse of step (b) and the first electrical pulse of step (c); and (e) 4 electrical pulses with a voltage of about 325 V with a pulse width of about 0.2 ms and a pulse interval of about 2 ms between each of 4 electrical pulses. Any values included in the value range described above are disclosed in the present application. Electroporation medium can be any suitable medium known in the art, such as BTXpress Cytoporation® Media T4, available from BTX. In some embodiments, the electroporation medium has conductivity in a range spanning about 0.01 to about 1.0 milliSiemens.

In some embodiments, as non limiting examples, an RNA encodes a rare-cutting endonuclease, one monomer of the rare-cutting endonuclease such as half-TALE-nuclease, a CAR, at least one component of the multi-chain chimeric antigen receptor, a pTα or functional variant thereof, an exogenous nucleic acid, and/or one additional catalytic domain.

Engineered Immune Cells

The disclosure also provides engineered immune cells comprising any of the CAR polynucleotides described herein. In some embodiments, a CAR can be introduced into an immune cell as a transgene via a plasmid vector. In some embodiments, the plasmid vector can also contain, for example, a selection marker which provides for identification and/or selection of cells which received the vector.

CAR polypeptides may be synthesized in situ in the cell after introduction of polynucleotides encoding the CAR polypeptides into the cell. Alternatively, CAR polypeptides may be be produced outside of cells, and then introduced into cells. Methods for introducing a polynucleotide construct into cells are known in the art. In some embodiments, stable transformation methods can be used to integrate the polynucleotide construct into the genome of the cell. In other embodiments, transient transformation methods can be used to transiently express the polynucleotide construct, and the polynucleotide construct not integrated into the genome of the cell. In other embodiments, virus-mediated methods can be used. The polynucleotides may be introduced into a cell by any suitable means such as for example, recombinant viral vectors (e.g. retroviruses, adenoviruses), liposomes, and the like. Transient transformation methods include, for example without limitation, microinjection, electroporation or particle bombardment. Polynucleotides may be included in vectors, such as for example plasmid vectors or viral vectors.

Also provided herein are isolated cells and cell lines obtained by the above-described methods of engineering cells provided herein. In some embodiments, an isolated cell comprises at least one CAR as described above. In some embodiments, an isolated cell comprises a population of CARs, each CAR comprising different extracellular ligand-binding domains.

Also provided herein are isolated immune cells obtained according to any one of the methods described above. Any immune cell capable of expressing heterologous DNAs can be used for the purpose of expressing the CAR of interest. In some embodiments, the immune cell is a T cell. In some embodiments, an immune cell can be derived from, for example without limitation, a stem cell. The stem cells can be adult stem cells, non-human embryonic stem cells, more particularly non-human stem cells, cord blood stem cells, progenitor cells, bone marrow stem cells, induced pluripotent stem cells, totipotent stem cells or hematopoietic stem cells. Representative human cells are CD34+ cells. The isolated cell can also be a dendritic cell, killer dendritic cell, a mast cell, a NK-cell, a B-cell or a T cell selected from the group consisting of inflammatory T-lymphocytes, cytotoxic T-lymphocytes, regulatory T-lymphocytes or helper T-lymphocytes. In some embodiments, the cell can be derived from the group consisting of CD4+ T-lymphocytes and CD8+ T-lymphocytes.

In some embodiments, the engineered immune cells expressing at their cell surface membrane a CD70-specific CAR of the disclosure comprise a percentage of stem cell memory and central memory cells greater than 10%, 20%, 30%, 40%, 50%, or 60%. In some embodiments, the engineered immune cells expressing at their cell surface membrane a CD70-specific CAR of the disclosure comprise a percentage of stem cell memory and central memory cells of about 10% to about 60%, about 10% to about 50%, about 10% to about 40%, about 15% to about 50%, about 15% to about 40%, about 20% to about 60%, or about 20% to about 70%.

In some embodiments, the immune cell is an inflammatory T-lymphocyte that expresses any one of the CARs described herein. In some embodiments, the immune cell is a cytotoxic T-lymphocyte that expresses any one of the CARs described herein. In some embodiments, the immune cell is a regulatory T-lymphocyte that expresses any one of the CARs described herein. In some embodiments, the immune cell is a helper T-lymphocyte that expresses any one of the CARs described herein.

Prior to expansion and genetic modification, a source of cells can be obtained from a subject through a variety of non-limiting methods. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and tumors. In some embodiments, any number of T cell lines available and known to those skilled in the art, may be used. In some embodiments, cells can be derived from a healthy donor, from a patient diagnosed with cancer or from a patient diagnosed with an infection. In some embodiments, cells can be part of a mixed population of cells which present different phenotypic characteristics.

Also provided herein are cell lines obtained from a transformed T cell according to any of the above-described methods. Also provided herein are modified cells resistant to an immunosuppressive treatment. In some embodiments, an isolated cell according to the disclosure comprises a polynucleotide encoding a CAR.

The immune cells of the disclosure can be activated and expanded, either prior to or after genetic modification of the T cells, using methods as generally described, for example without limitation, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005. T cells can be expanded in vitro or in vivo. Generally, the T cells of the disclosure can be expanded, for example, by contact with an agent that stimulates a CD3 TCR complex and a co-stimulatory molecule on the surface of the T cells to create an activation signal for the T cell. For example, chemicals such as calcium ionophore A23187, phorbol 12-myristate 13-acetate (PMA), or mitogenic lectins like phytohemagglutinin (PHA) can be used to create an activation signal for the T cell.

In some embodiments, T cell populations may be stimulated in vitro by contact with, for example, an anti-CD3 antibody, or antigen-binding fragment thereof, or an anti-CD2 antibody immobilized on a surface, or by contact with a protein kinase C activator (e.g., bryostatin) in conjunction with a calcium ionophore. For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. The anti-CD3 antibody and an anti-CD28 antibody can be disposed on a bead or plate or other substrate. Conditions appropriate for T cell culture include an appropriate media (e.g., Minimal Essential Media or RPMI Media 1640 or, X-vivo 5, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-2, IL-15, TGFp, and TNF, or any other additives for the growth of cells known to the skilled artisan. Other additives for the growth of cells include, but are not limited to, surfactant, plasmanate, and reducing agents such as N-acetyl-cysteine and 2-mercaptoethanol. Media can include RPMI 1640, A1M-V, DMEM, MEM, a-MEM, F-12, X-Vivo 1, and X-Vivo 20, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells (e.g., IL-7 and/or IL-15). Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° C.) and atmosphere (e.g., air plus 5% $CO_2$). T cells that have been exposed to varied stimulation times may exhibit different characteristics In some embodiments, the cells of the disclosure can be expanded by co-culturing with tissue or cells. The cells can also be expanded in vivo, for example in the subject's blood after administering the cell into the subject.

In some embodiments, an isolated cell according to the present disclosure comprises one disrupted or inactivated gene selected from the group consisting of CD52, CD70, GR, PD-1, CTLA-4, LAG3, Tim3, BTLA, BY55, TIGIT, B7H5, LAIR1, SIGLEC10, 2B4, HLA, TCRα and TCRβ and/or expresses a CAR, a multi-chain CAR and/or a pTα transgene. In some embodiments, an isolated cell comprises polynucleotides encoding polypeptides comprising a multi-chain CAR. In some embodiments, the isolated cell according to the present disclosure comprises two disrupted or inactivated genes selected from the group consisting of: CD52 and GR, CD52 and TCRα, CDR52 and TCRβ, CD70 and CD52, CD70 and TCRα, CD70 and TCRβ, GR and TCRα, GR and TCRβ, TCRα and TCRβ, PD-1 and TCRα, PD-1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ and/or expresses a CAR, a multi-chain CAR and a pTα transgene.

In some embodiments, the isolated cell according to the present disclosure comprises three disrupted or inactivated genes selected from CD52, CD70 and TCRα or CD52, CD70 and TCRβ and/or expresses a CAR, a multi-chain CAR and a pTα transgene.

In some embodiments, TCR is rendered not functional in the cells according to the disclosure by disrupting or inactivating TCRα gene and/or TCRβ gene(s). In some embodiments, a method to obtain modified cells derived from an individual is provided, wherein the cells can proliferate independently of the major histocompatibility complex (MHC) signaling pathway. Modified cells, which can proliferate independently of the MHC signaling pathway, susceptible to be obtained by this method are encompassed in the scope of the present disclosure. Modified cells disclosed herein can be used in for treating patients in need thereof against Host versus Graft (HvG) rejection and Graft versus Host Disease (GvHD); therefore in the scope of the present disclosure is a method of treating patients in need thereof against Host versus Graft (HvG) rejection and Graft versus Host Disease (GvHD) comprising treating said patient by administering to said patient an effective amount of modified cells comprising disrupted or inactivated TCRα and/or TCRβ genes.

In some embodiments, the immune cells are engineered to be resistant to one or more chemotherapy drugs. The chemotherapy drug can be, for example, a purine nucleotide analogue (PNA), thus making the immune cell suitable for cancer treatment combining adoptive immunotherapy and chemotherapy. Exemplary PNAs include, for example, clofarabine, fludarabine, cyclophosphamide, and cytarabine, alone or in combination. PNAs are metabolized by deoxycytidine kinase (dCK) into mono-, di-, and tri-phosphate PNA. Their tri-phosphate forms compete with ATP for DNA synthesis, act as pro-apoptotic agents, and are potent inhibitors of ribonucleotide reductase (RNR), which is involved in trinucleotide production. Provided herein are CD70-specific CAR-T cells comprising an disrupted or inactivated dCK gene. In some embodiments, the dCK knockout cells are made by transfection of T cells using polynucleotides encoding specific TAL-nuclease directed against dCK genes by, for example, electroporation of mRNA. The dCK knockout CD70-specific CAR-T cells can be resistant to PNAs, including for example clorofarabine and/or fludarabine, and maintain T cell cytotoxic activity toward CD70-expressing cells.

In some embodiments, isolated cells or cell lines of the disclosure can comprise a pTα or a functional variant thereof. In some embodiments, an isolated cell or cell line can be further genetically modified by disrupting or inactivating the TCRα gene.

Monoclonal Antibody-Specific Epitopes

In some embodiments, the extracellular domain of any one of the CD70-specific CARs disclosed herein may comprise one or more epitopes specific for (i.e., specifically recognized by) a monoclonal antibody. These epitopes are also referred to herein as mAb-specific epitopes. Exemplary mAb-specific epitopes are disclosed in International Patent Publication No. WO 2016/120126, which is incorporated herein in its entirety. In these embodiments, the extracellular domain comprises the VH and VL polypeptides that specifically bind to CD70 and one or more epitopes that bind to one or more monoclonal antibodies (mAbs). CARs comprising the mAb-specific epitopes can be single-chain or multi-chain.

The inclusion of epitopes specific for monoclonal antibodies in the extracellular domain of the CARs described herein allows sorting and depletion of engineered immune cells expressing the CARs. In some embodiments, this feature also promotes recovery of endogenous CD70-expressing cells that were depleted by administration of engineered immune cells expressing the CARs.

Accordingly, in some embodiments, the present disclosure relates to a method for sorting and/or depleting the engineered immune cells endowed with the CARs comprising mAb-specific epitopes and a method for promoting recovery of endogenous CD70-expressing cells, such as bone marrow progenitor cells.

Several epitope-monoclonal antibody couples can be used to generate CARs comprising monoclonal antibody specific epitopes; in particular, those already approved for medical use, such as CD20 epitope/rituximab as a non-limiting example.

The disclosure also encompasses methods for sorting the engineered immune cells endowed with the CD70-specific CARs expressing the mAb-specific epitope(s) and therapeutic methods where the activation of the engineered immune cells endowed with these CARs is modulated by depleting the cells using an antibody that targets the external ligand binding domain of said CARs.

```
Rituximab
Mimotope
                                        SEQ ID NO: 293
CPYSNPSLC Palivizumab
Epitope
                                        SEQ ID NO: 660
NSELLSLINDMPITNDQKKLMSNN Cetuximab
Mimotope 1
                                        SEQ ID NO: 603
CQFDLSTRRLKC Mimotope 2
                                        SEQ ID NO: 604
CQYNLSSRALKC Mimotope 3
                                        SEQ ID NO: 605
CVWQRWQKSYVC Mimotope 4
                                        SEQ ID NO: 606
CMWDRFSRWYKC Nivolumab
Epitope 1
                                        SEQ ID NO: 607
SFVLNWYRMSPSNQTDKLAAFPEDR Epitope 2
                                        SEQ ID NO: 608
SGTYLCGAISLAPKAQIKE QBEND-10
Epitope 1
                                        SEQ ID NO: 609
ELPTQGTFSNVSTNVS Epitope 2
                                        SEQ ID NO: 295
ELPTQGTFSNVSTNVSPAKPTTTA Alemtuzumab
Epitope
                                        SEQ ID NO: 610
GQNDTSQTSSPS
```

In some embodiments, the CAR-T cell comprises a polynucleotide encoding a suicide polypeptide, such as for example RQR8. See, e.g., WO2013153391A, which is hereby incorporated by reference in its entirety. In CAR-T cells comprising the polynucleotide, the suicide polypeptide is expressed at the surface of a CAR-T cell. In some embodiments, the suicide polypeptide comprises the amino acid sequence shown in SEQ ID NO: 291.

```
                                        (SEQ ID NO: 291)
CPYSNPSLCSGGGGSELPTQGTFSNVSTNVSPAKPTTTACPYSNPSLCSG

GGGSPAPRPPTPAPTIASQPLSLRPEACRPAAGGAVHTRGLDFACDIYIW

APLAGTCGVLLLSLVITLYCNHRNRRRVCKCPRPVV.
```

The suicide polypeptide may also comprise a signal peptide at the amino terminus—for example, MGTSLLCWMALCLLGADHADA (SEQ ID NO: 611). In some embodiments, the suicide polypeptide comprises the amino acid sequence shown in SEQ ID NO: 292, which includes the signal sequence of SEQ ID NO: 611.

```
                                        (SEQ ID NO: 292)
MGTSLLCWMALCLLGADHADACPYSNPSLCSGGGGSELPTQGTFSNVSTN

VSPAKPTTTACPYSNPSLCSGGGGSPAPRPPTPAPTIASQPLSLRPEACR

PAAGGAVHTRGLDFACDIYIWAPLAGTCGVLLLSLVITLYCNHRNRRRVC

KCPRPVV.
```

In some embodiments, the suicide polypeptide comprises the amino acid sequence of SEQ ID NO: 611

When the suicide polypeptide is expressed at the surface of a CAR-T cell, binding of rituximab to the R epitopes of the polypeptide causes lysis of the cell. More than one molecule of rituximab may bind per polypeptide expressed at the cell surface. Each R epitope of the polypeptide may bind a separate molecule of rituximab. Deletion of CD70-specific CAR-T cells may occur in vivo, for example by administering rituximab to a patient. The decision to delete the transferred cells may arise from undesirable effects being detected in the patient which are attributable to the transferred cells, such as for example, when unacceptable levels of toxicity are detected.

In some embodiments, upon administration to a patient, engineered immune cells expressing at their cell surface any one of the CD70-specific CARs described herein may reduce, kill or lyse endogenous CD70-expressing cells of the patient. In one embodiment, a percentage reduction or lysis of CD70-expressing endogenous cells or cells of a cell line expressing CD70 by engineered immune cells expressing any one of the CD70-specific CARs described herein is at least about or greater than 10%, 15%, 20%, 25%, 30%, 35%, 40%, 45%, 50%, 55%, 60%, 65%, 70%, 75%, 80%, 85%, 90%, or 95%. In one embodiment, a percentage reduction or lysis of CD70-expressing endogenous cells or cells of a cell line expressing CD70 by engineered immune cells expressing any one of the CD70-specific CARs described herein is about 5% to about 95%, about 10% to about 95%, about 10% to about 90%, about 10% to about 80%, about 10% to about 70%, about 10% to about 60%, about 10% to about 50%, about 10% to about 40%, about 20% to about 90%, about 20% to about 80%, about 20% to about 70%, about 20% to about 60%, about 20% to about 50%, about 25% to about 75%, or about 25% to about 60%. In one embodiment, the endogenous CD70-expressing cells are endogenous CD70-expressing bone marrow cells.

In one embodiment, the percent reduction or lysis of target cells, e.g., a cell line expressing CD70, by engineered immune cells expressing at their cell surface membrane a CD70-specific CAR of the disclosure can be measured using the assay disclosed herein.

Method for Sorting CAR-Positive Immune Cells

In one aspect, provided are methods for in vitro sorting of a population of immune cells, wherein a subset of the population of immune cells comprises engineered immune cells expressing any one of the CD70-specific CARs comprising epitopes specific for monoclonal antibodies described herein. The method comprises contacting the population of immune cells with a monoclonal antibody specific for the epitopes and selecting the immune cells that bind to the monoclonal antibody to obtain a population of cells enriched in engineered immune cells expressing CD70-specific CAR.

In some embodiments, said monoclonal antibody specific for said epitope is optionally conjugated to a fluorophore. In this embodiment, the step of selecting the cells that bind to the monoclonal antibody can be done by Fluorescence Activated Cell Sorting (FACS). In some embodiments, said monoclonal antibody specific for said epitope is optionally conjugated to a magnetic particle. In this embodiment, the step of selecting the cells that bind to the monoclonal antibody can be done by Magnetic Activated Cell Sorting (MACS).

In some embodiments, the extracellular binding domain of the CAR comprises a mAb-specific epitope of one or more of SEQ ID NO: 294 or 601-610 In some embodiments, the extracellular binding domain of the CAR comprises a mAb-specific epitope of SEQ ID NO: 609. In some embodiments, the extracellular binding domain of the CAR comprises a mAb-specific epitope of SEQ ID NO: 295. In some embodiments, the extracellular binding domain of the CAR comprises a mAb-specific epitope of SEQ ID NO: 609 and the antibody used to contact the population of immune cells is QBEND-10. In some embodiments, the extracellular binding domain of the CAR comprises a mAb-specific epitope of SEQ ID NO: 295 and the antibody used to contact the population of immune cells is QBEND-10.

In some embodiments, the extracellular binding domain of the CAR comprises a mAb-specific epitope of SEQ ID NO: 294. In some embodiments, the extracellular binding domain of the CAR comprises a mAb-specific epitope of SEQ ID NO: 294 and the antibody used to contact the population of immune cells is Rituximab.

In some embodiments, the population of CAR-expressing immune cells obtained when using the method for in vitro sorting of immune cells described above, comprises at least 60%, 65%, 70%, 75%, 80%, 85%, 90%, or 95% of CAR-expressing immune cells. In some embodiments, the population of CD70 CAR-expressing immune cells obtained when using the method for in vitro sorting of CAR-expressing immune cells described above, comprises at least 85% of CAR-expressing immune cells.

According to the disclosure, cells to be administered to the recipient may be enriched in vitro from the source population. Methods of expanding source populations are well known in the art, and may include selecting cells that express an antigen such as CD34 antigen, using combinations of density centrifugation, immuno-magnetic bead purification, affinity chromatography, and fluorescent activated cell sorting, known to those skilled in the art.

Flow cytometry is widely used in the art and is a method well known to one of ordinary skill to sort and quantify specific cell types within a population of cells. In general, flow cytometry is a method for quantitating components or structural features of cells primarily by optical means. Since different cell types can be distinguished by quantitating structural features, flow cytometry and cell sorting can be used to count and sort cells of different phenotypes in a mixture.

A flow cytometric analysis involves two basic steps: 1) labeling selected cell types with one or more labeled markers, and 2) determining the number of labeled cells relative to the total number of cells in the population.

The primary method of labeling cell types is by binding labeled antibodies to markers expressed by the specific cell type. The antibodies are either directly labeled with a fluorescent compound or indirectly labeled using, for example, a fluorescent-labeled second antibody which recognizes the first antibody.

In some embodiments, the method used for sorting immune cells expressing a CAR is the Magnetic-Activated Cell Sorting (MACS). Magnetic-activated cell sorting (MACS) is a method for separation of various cell populations depending on their surface antigens (CD molecules) by using superparamagnetic nanoparticles and columns. It takes a few simple steps to get pure cell populations. Cells in a single-cell suspension are magnetically labeled with microbeads. The sample is applied to a column composed of ferromagnetic spheres, which are covered with a cell-friendly coating allowing fast and gentle separation of cells. The unlabeled cells pass through while the magnetically labeled cells are retained within the column. The flow-through can be collected as the unlabeled cell fraction. After a short washing step, the column is removed from the separator, and the magnetically labeled cells are eluted from the column.

In some embodiments, the mAb used in the method for sorting immune cells expressing the CAR is chosen from alemtuzumab, ibritumomab tiuxetan, muromonab-CD3, tositumomab, abciximab, basiliximab, brentuximab vedotin, cetuximab, infliximab, rituximab, bevacizumab, certolizumab pegol, daclizumab, eculizumab, efalizumab, gemtuzumab, natalizumab, omalizumab, palivizumab, ranibizumab, tocilizumab, trastuzumab, vedolizumab, adalimumab, belimumab, canakinumab, denosumab, golimumab, ipilimumab, ofatumumab, panitumumab, QBEND-10 and/or ustekinumab. In some embodiments, said mAb is rituximab. In another embodiment, said mAb is QBEND-10.

In some embodiments, the CAR-T cell comprises a selected epitope within the scFv having a specificity to be recognized by a specific antibody. See, e.g., WO2016/120216, which is hereby incorporated by reference in its entirety. Such an epitope facilitates sorting and/or depleting the CAR-T cells. The epitope can be selected from any number of epitopes known in the art. In some embodiments, the epitope can be a target of a monoclonal antibody approved for medical use, such as, for example without limitation, the CD20 epitope recognized by rituximab. In some embodiments, the epitope comprises the amino acid sequence CPYSNPSLC (SEQ ID NO: 293)

In some embodiments, the epitope is located within the CAR. For example without limitation, the epitope can be located between the scFv and the hinge of a CAR. In some embodiments, two instances of the same epitope, separated by linkers, may be used in the CAR. For example, the polypeptide comprising the amino acid sequence shown in SEQ ID NO: 294 or in SEQ ID NO: 609 or SEQ ID NO: 295 can be used within a CAR, located between the light chain variable region and the hinge.

```
                                          (SEQ ID NO: 294)
GSGGGGSCPYSNPSLCSGGGGSCPYSNPSLCSGGGGS (SEQ ID NO: 609)
ELPTQGTFSNVSTNVS (SEQ ID NO: 295)
ELPTQGTFSNVSTNVSPAKPTTTA
```

In some embodiments, the extracellular binding domain of the CAR comprises the following sequence $V_1$-$L_1$-$V_2$-$(L)_x$-Epitope1-$(L)_x$-;
$V_1$-$L_1$-$V_2$-$(L)_x$-Epitope1-$(L)_x$-Epitope2-$(L)_x$-;
$V_1$-$L_1$-$V_2$-$(L)_x$-Epitope1-$(L)_x$-Epitope2-$(L)_x$-Epitope3-$(L)_x$-;
$(L)_x$-Epitope1-$(L)_x$-$V_1$-$L_1$-$V_2$;
$(L)_x$-Epitope1-$(L)_x$-Epitope2-$(L)_x$-$V_1$-$L_1$-$V_2$;
Epitope1-$(L)_x$-Epitope2-$(L)_x$-Epitope3-$(L)_x$-$V_1$-$L_1$-$V_2$;
$(L)_x$-Epitope1-$(L)_x$-$V_1$-$L_1$-$V_2$-$(L)_x$-Epitope2-$(L)_x$;
$(L)_x$-Epitope1-$(L)_x$-$V_1$-$L_1$-$V_2$-$(L)_x$-Epitope2-$(L)_x$-Epitope3-$(L)_x$-;
$(L)_x$-Epitope1-$(L)_x$-$V_1$-$L_1$-$V_2$-$(L)_x$-Epitope2-$(L)_x$-Epitope3-$(L)_x$-Epitope4-$(L)_x$-;
$(L)_x$-Epitope1-$(L)_x$-Epitope2-$(L)_x$-$V_1$-$L_1$-$V_2$-$(L)_x$-Epitope3-$(L)_x$-;
$(L)_x$-Epitope1-$(L)_x$-Epitope2-$(L)_x$-$V_1$-$L_1$-$V_2$-$(L)_x$-Epitope3-$(L)_x$-Epitope4-$(L)_x$-;
$V_1$-$(L)_x$-Epitope1-$(L)_x$-$V_2$;
$V_1$-$(L)_x$-Epitope1-$(L)_x$-$V_2$-$(L)_x$-Epitope2-$(L)_x$;
$V_1$-$(L)_x$-Epitope1-$(L)_x$-$V_2$-$(L)_x$-Epitope2-$(L)_x$-Epitope3-$(L)_x$;
$V_1$-$(L)_x$-Epitope1-$(L)_x$-$V_2$-$(L)_x$-Epitope2-$(L)_x$-Epitope3-$(L)_x$-Epitope4-$(L)_x$;
$(L)_x$-Epitope1-$(L)_x$-$V_1$-$(L)_x$-Epitope2-$(L)_x$-$V_2$; or,
$(L)_x$-Epitope1-$(L)_x$-$V_1$-$(L)_x$-Epitope2-$(L)_x$-$V_2$-$(L)_x$-Epitope3-$(L)_x$;

wherein, $V_1$ is $V_L$ and $V_2$ is $V_H$ or $V_1$ is $V_H$ and $V_2$ is $V_L$;
$L_1$ is a linker suitable to link the $V_H$ chain to the $V_L$ chain;
L is a linker comprising glycine and serine residues, and each occurrence of L in the extracellular binding domain can be identical or different to other occurrence of L in the same extracellular binding domain, which in embodiments comprises or is SGGGG (SEQ ID NO: 614), GGGGS (SEQ ID NO: 615) or SGGGGS (SEQ ID NO: 616), and,
x is 0 or 1 or 2 and each occurrence of x is selected independently from the others; and, Epitope 1, Epitope 2, Epitope 3 and Epitope 4 are mAb-specific epitopes and can be identical or different and wherein $V_H$ is an heavy chain variable fragment and $V_L$ is a light chain variable fragment. In some embodiments, Epitope 1, Epitope 2 and Epitope 4 are a mAb-specific epitope having an amino acid sequence of SEQ ID NO:293 and Epitope 3 is a mAb-specific epitope having an amino acid sequence of SEQ ID NO: 609.

In some embodiments, the extracellular binding domain of the CAR comprises the following sequence $V_1$-$L_1$-$V_2$-$(L)_x$-Epitope1-$(L)_x$-Epitope2-$(L)_x$-; or,
$(L)_x$-Epitope1-$(L)_x$-$V_1$-$L_1$-$V_2$-$(L)_x$-Epitope2-$(L)_x$-Epitope3-$(L)_x$-Epitope4-$(L)_x$- wherein $V_1$, $V_2$, $L_1$, L, x and Epitope 1, Epitope 2, Epitope 3 and Epitope 4 are as defined above.

In some embodiments, the extracellular binding domain of the CAR comprises the following sequence $(L)_x$-Epitope1-$(L)_x$-$V_1$-$L_1$-$V_2$-$(L)_x$-Epitope2-$(L)_x$-Epitope3-$(L)_x$-Epitope4-$(L)_x$- wherein $V_1$, $V_2$, $L_1$, L, x are as defined above and wherein $(L)_x$-Epitope1-$(L)_x$ is

```
                                          (SEQ ID NO: 617)
GGGGSCPYSNPSLCSGGGGSGGGGS,
```

$(L)_x$-Epitope2-$(L)_x$-Epitope3-$(L)_x$-Epitope4 is

```
                                          (SEQ ID NO: 618)
GSGGGGSCPYSNPSLCSGGGGSELPTQGTFSNVSTNVSPAKPTTTACPYS
NPSLC
``` and and $V_1$, $V_2$, $L_1$, L, x are as defined above.

In some embodiments, the epitope-specific antibody may be conjugated with a cytotoxic drug. It is also possible to promote CDC cytotoxicity by using engineered antibodies on which are grafted component(s) of the complement system. In some embodiments, activation of the CAR-T cells can be modulated by depleting the cells using an antibody which recognizes the epitope.

Therapeutic Applications

Isolated cells obtained by the methods described above, or cell lines derived from such isolated cells, can be used as a medicament. In some embodiments, such a medicament can be used for treating cancer. In some embodiments, the cancer is Renal Cell Carcinoma, Glioblastoma, glioma such as low grade glioma, Non-Hodgkin's Lymphoma (NHL), Hodgkin's Disease (HD), Waldenstrom's macroglobulinemia, Acute Myeloid Leukemia, Multiple Myeloma, diffuse large-cell lymphoma, follicular lymphoma or Non-Small Cell Lung Cancer.

In some embodiments, the cancer is of hematopoeietic origin, such as a lymphoma or leukemia. In some embodiments, the cancer is selected from the group consisting of multiple myeloma, malignant plasma cell neoplasm, Hodgkin's lymphoma, nodular lymphocyte predominant Hodgkin's lymphoma, Kahler's disease and Myelomatosis, plasma cell leukemia, plasmacytoma, B-cell prolymphocytic leukemia, hairy cell leukemia, B-cell non-Hodgkin's lymphoma (NHL), acute myeloid leukemia (AML), chronic lymphocytic leukemia (CLL), acute lymphocytic leukemia (ALL), chronic myeloid leukemia (CML), follicular lymphoma, Burkitt's lymphoma, marginal zone lymphoma, mantle cell lymphoma, large cell lymphoma, precursor B-lymphoblastic lymphoma, myeloid leukemia, Waldenstrom's macroglobulienemia, diffuse large B cell lymphoma, follicular lymphoma, marginal zone lymphoma, mucosa-associated lymphatic tissue lymphoma, small cell lymphocytic lymphoma, mantle cell lymphoma, Burkitt lymphoma, primary mediastinal (thymic) large B-cell lymphoma, lymphoplasmactyic lymphoma, Waldenström macroglobulinemia, nodal marginal zone B cell lymphoma, splenic marginal zone lymphoma, intravascular large B-cell lymphoma, primary effusion lymphoma, lymphomatoid granulomatosis, T cell/histiocyte-rich large B-cell lymphoma, primary central nervous system lymphoma, primary cutaneous diffuse large B-cell lymphoma (leg type), EBV positive diffuse large B-cell lymphoma of the elderly, diffuse large B-cell lymphoma associated with inflammation, intravascular large B-cell lymphoma, ALK-positive large B-cell lymphoma, plasmablastic lymphoma, large B-cell lymphoma arising in HHV8-associated multicentric Castleman disease, B-cell lymphoma unclassified with features intermediate between diffuse large B-cell lymphoma and Burkitt lymphoma, B-cell lymphoma unclassified with features intermediate between diffuse large B-cell lymphoma and classical Hodgkin lymphoma, and other hematopoietic cells related cancer, e.g. ALL or AML.

In some embodiments, an isolated cell according to the disclosure, or cell line derived from the isolated cells, can be used in the manufacture of a medicament for treatment of a cancer in a patient in need thereof.

Also provided herein are methods for treating patients. In some embodiments the method comprises providing an immune cell of the disclosure to a patient in need thereof. In some embodiments, the method comprises a step of administering transformed immune cells of the disclosure to a patient in need thereof.

In some embodiments, T cells of the disclosure can undergo robust in vivo T cell expansion and can persist for an extended amount of time.

Methods of treatment of the disclosure can be ameliorating, curative or prophylactic. The method of the disclosure may be either part of an autologous immunotherapy or part of an allogenic immunotherapy treatment. The disclosure is particularly suitable for allogeneic immunotherapy. T cells from donors can be transformed into non-alloreactive cells using standard protocols and reproduced as needed, thereby producing CAR-T cells which may be administered to one or several patients. Such CAR-T cell therapy can be made available as an "off the shelf" therapeutic product.

Cells that can be used with the disclosed methods are described in the previous section. Treatment can be used to treat patients diagnosed with, for example, cancer. Cancers that may be treated include, for example without limitation, cancers that involve B lymphocytes, including any of the above-listed cancers. Types of cancers to be treated with the CARs and CAR-T cells of the disclosure include, but are not limited to certain leukemia or lymphoid malignancies. Adult tumors/cancers and pediatric tumors/cancers are also included. In some embodiments, the treatment can be in combination with one or more therapies against cancer selected from the group of antibodies therapy, chemotherapy, cytokines therapy, dendritic cell therapy, gene therapy, hormone therapy, laser light therapy and radiation therapy.

In some embodiments, treatment can be administered into patients undergoing an immunosuppressive treatment. Indeed, the methods of the disclosure, in some embodiments, rely on cells or population of cells, which have been made resistant to at least one immunosuppressive agent due to the inactivation of a gene encoding a receptor for such immunosuppressive agent. In this aspect, the immunosuppressive treatment should help the selection and expansion of the T cells according to the disclosure within the patient. The administration of the cells or population of cells according to the disclosure may be carried out in any convenient manner, including by aerosol inhalation, injection, ingestion, infusion, transfusion, implantation or transplantation. The compositions described herein may be administered to a patient subcutaneously, intradermally, intratumorally, intranodally, intramedullary, intramuscularly, by intravenous or intralymphatic injection or infusion, or intraperitoneally. In some embodiments, the cell compositions of the disclosure are administered by intravenous injection or infusion.

In some embodiments the administration of the cells or population of cells can comprise administration of, for example, about $10^4$ to about $10^9$ cells per kg body weight including all integer values of cell numbers within those ranges. In some embodiments the administration of the cells or population of cells can comprise administration of about $10^5$ to about $10^6$ cells per kg body weight including all integer values of cell numbers within those ranges. The cells or population of cells can be administered in one or more doses. In some embodiments, said effective amount of cells can be administered as a single dose. In some embodiments, said effective amount of cells can be administered as more than one dose over a period time. Timing of administration is within the judgment of managing physician and depends on the clinical condition of the patient. The cells or population of cells may be obtained from any source, such as the patient, a blood bank, or a donor. While individual needs vary, determination of optimal ranges of effective amounts of a given cell type for a particular disease or conditions within the skill of the art. An effective amount means an amount which provides a therapeutic or prophylactic benefit. The dosage administered will be dependent upon the age, health and weight of the recipient, kind of concurrent treatment, if any, frequency of treatment and the nature of the effect desired. In some embodiments, an effective amount of cells or composition comprising those cells are administered parenterally. In some embodiments, administration can be an intravenous administration. In some embodiments, administration can be directly done by injection within a tumor.

In some embodiments, the methods involve (a) administering to a subject having a disease a first dose of allogeneic CAR-T cells. In some embodiments, the first dose contains about $1 \times 10^4$ cells, about $5 \times 10^4$ cells, about $1 \times 10^5$ cells, about $5 \times 10^5$ cells, about $1 \times 10^6$ cells, about $5 \times 10^6$ cells, about $6 \times 10^6$ cells, about $1 \times 10^7$ cells, about $6 \times 10^7$ cells, about $1 \times 10^8$, about $1.8 \times 10^8$ cells, or about $4.8 \times 10^8$ cells. In some embodiments, the methods further involve (b) administering to the subject a subsequent dose of CAR-T cells at a time point that is at least or more than about 5 weeks after and less than about 24 weeks after initiation of the administration in (a).

In some embodiments, a subject with relapsed/refractory disease (e.g., relapsed/refractory RCC) is administered a first and subsequent dose of allogeneic CAR-T cells each contain about $6 \times 10^6$ cells, and the subsequent dose of CAR-T cells in (b) is administered about 99 days after initiation of the administration in (a).

In some embodiments, the methods further involve the administration of additional subsequent or subsequent doses, such that a first and multiple subsequent doses are administered, e.g., in accordance with the dosing amounts and timing schedules as specified for the first and subsequent doses. In some embodiments, the first of one or more subsequent doses is administered at a time that is at least or greater than 5 weeks after the initiation of the administration of the subsequent dose. In some embodiments, the administration of the first, subsequent, and subsequent doses includes administering at least three of the doses within at or about 5 weeks. In some embodiments, the subsequent dose is administered at about 16 weeks following the initiation of administration of the first dose, and an additional subsequent or subsequent dose is administered at week 17 following the initiation of administration of the first dose. In some embodiments, additional subsequent doses are administered at week 17 and/or week 34 following the initiation of administration of the first dose.

In some aspects, the time of administering the subsequent dose(s) is further one at which the subject does not exhibit an immune response, e.g., does not exhibit a detectable adaptive host immune response specific for the CAR-T said first (or prior) dose.

In some embodiments, the time between the administration of the first dose (initial dose), e.g., the initiation of the administration of the first or prior dose, and the initiation of the administration of the subsequent dose (e.g., the initiation of the administration of the subsequent dose) is greater than about 4 weeks, e.g., greater than about 5, 6, 7, 8, or 9 days, e.g., greater than about 20 weeks, e.g., between about 9 and about 35 weeks, between about 14 and about 28 weeks, between 15 and 27 weeks, or between 16 weeks and about 18 weeks; and/or at or about 15, 16, 17, 18, 19, 20, 21, 22, 23, 24, 25, 26, or 27 weeks. In some embodiments, administration of the subsequent dose (e.g., initiation thereof) is more than about 5 weeks after and less than about 24 weeks after administration of the first or prior dose (e.g., initiation thereof). In some embodiments, the administration of the subsequent dose is initiated 17 weeks following the initiation of the first dose. In some embodiments, the time between administration of the first and the subsequent dose (e.g., initiation thereof) or prior and next subsequent dose is greater than about 5 weeks and less than about 24 weeks, such as between 10 and 24 weeks, such as about 17 weeks. In some embodiments, the time between administration of the first and the subsequent dose (e.g., initiation thereof) is about 17 weeks.

In some embodiments of the disclosure, cells are administered to a patient in conjunction with (e.g., before, simultaneously or following) any number of relevant treatment modalities, including but not limited to treatment with agents such as monoclonal antibody therapy, CCR2 antagonist (e.g., INC-8761), antiviral therapy, cidofovir and interleukin-2, cytarabine (also known as ARA-C) or nataliziimab treatment for MS patients or efaliztimab treatment for psoriasis patients or other treatments for PML patients. In some embodiments, CD70-specific CAR-T cells are administered to a patient in conjunction with one or more of the following: an anti-PD-1 antibody (e.g., nivolumab, pembrolizumab, or PF-06801591), an anti-PD-L1 antibody (e.g., avelumab, atezolizumab, or durvalumab), an anti-OX40 antibody (e.g., PF-04518600), an anti-4-1BB antibody (e.g., PF-05082566), an anti-MCSF antibody (e.g., PD-0360324), an anti-GITR antibody, and/or an anti-TIGIT antibody. In some embodiments, a CD70-specific CAR comprising the amino acid sequence shown in SEQ ID NO: 319 or 327 is administered to a patient in conjunction with anti-PD-L1 antibody avelumab. In further embodiments, the T cells of the disclosure may be used in combination with chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludaribine, cyclosporin, FK506, rapamycin, mycoplienolic acid, steroids, FR901228, cytokines, and/or irradiation. These drugs inhibit either the calcium dependent phosphatase calcineurin (cyclosporine and FK506) or inhibit the p70S6 kinase that is important for growth factor induced signaling (rapamycin) (Henderson, Naya et al. 1991; Liu, Albers et al. 1992; Bierer, Hollander et al. 1993). In further embodiments, the T cells of the disclosure may be used in combination with Receptor Tyrosine Kinase inhibitors such as Midostaurin, Sunitinib and axitanib, mTOR inhibitors such as Rapamacyn and Everolimus, epigenetic modulators such as Vormostat, proteasome inhibitors such as Bortezomib, immunomodulatory agents such as lenalidomide, Hedgehog inhibitors such as Erismodegib and PF-04449913 or Isocitrate Dehydrogenase (IDH) inhibitors such as AG-120 and AG-221. In a further embodiment, the cell compositions of the disclosure are administered to a patient in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH, In some embodiments, the cell compositions of the disclosure are administered following B-cell ablative therapy such as agents that react with CD20, e.g., Rituxan. For example, in some embodiments, subjects may undergo standard treatment with high dose chemotherapy followed by peripheral blood stem cell transplantation. In certain embodiments, following the transplant, subjects receive an infusion of the expanded immune cells of the disclosure. In some embodiments, expanded cells are administered before or following surgery.

In some embodiments, provided are methods for depleting CD70-specific CAR-expressing engineered immune cells from a subject adminstered with said cells. Depletion can be by inhibition or elimination.

In one aspect, a method for depleting engineered immune cells expressing a CD70-specific CAR comprising an epitope specific for a monoclonal antibody comprises contacting said engineered immune cell with a monoclonal antibody specific for the epitope.

In some embodiments, a method for depleting from a subject administered with engineered immune cells expressing a CD70-specific CAR comprising an epitope specific for a monoclonal antibody comprises administering to the subject a monoclonal antibody specific for the epitope. In these embodiments, administration of the monoclonal antibody specific for the epitope present in the extracellular domain of the CAR to the subject eliminates or inhibits the activity of engineered CAR-expressing immune cells from the subject. In one aspect, depletion of engineered CAR expressing immune cells allows for recovery of an endogenous population of CD70-expressing cells.

In one aspect, the disclosure relates to a method for promoting recovery of endogenous CD70-expressing cells in a subject administered with engineered immune cells expressing at cell surface a CD70-specific CAR comprising an epitope specific for a monoclonal antibody, the method comprising administering a monoclonal antibody specific for the epitope to the subject. In some embodiments, endogenous CD70-expressing cells are endogenous CD70-expressing bone marrow cells. In one aspect, the term "recovery" refers to increasing the number of endogenous CD70-expressing cells. The number of endogenous CD70-expressing cells may increase due to increase in proliferation of endogenous CD70-expressing cells and/or due to reduction in elimination of endogenous CD70-expressing cells by CAR expressing engineered immune cells. In some embodiments, administration of the monoclonal antibody to the subject depletes the CAR expressing engineered immune cells and increases the number of endogenous CD70-expressing cells, e.g., endogenous CD70-expressing bone marrow progenitor cells, in the subject. In one embodiment, administration of the monoclonal antibody to the subject increases the number of endogenous CD70-expressing cells by at least about 10%, 15%, 20%, 25%, 30%, 35%, 40%, 45%, 50%, 55%, 60%, 65%, 70%, 75%, 80%, 85%, 90%, or 95%, compared to the number of endogenous CD70-expressing cells prior to administration of the monoclonal antibody.

In one aspect, provided is a method for treating a CD70-mediated condition in a subject, the method comprising: (a) administering to the subject engineered immune cells expressing at cell surface CD70-specific CARs comprising one or more epitopes specific for one or more monoclonal antibodies; and (b) subsequently depleting the engineered immune cells from the subject by administering one or more monoclonal antibodies specific for the epitope to the subject.

In some embodiments, the mAbs used in the method for depleting CAR-expressing engineered immune cells are selected from alemtuzumab, ibritumomab tiuxetan, muromonab-CD3, tositomomab, abciximab, basiliximab, brentuximab vedotin, cetuximab, infliximab, rituximab, bevacizumab, certolizumab pegol, daclizumab, eculizumab, efalizumab, gemtuzumab, natalizumab, omalizumab, palivizumab, ranibizumab, tocilizumab, trastuzumab, vedolizumab, adalimumab, belimumab, canakinumab, denosumab, golimumab, ipilimumab, ofatumumab, panitumumab, QBEND-10, ustekinumab, and combinations thereof.

In some embodiments, said epitope specific for a monoclonal antibody (mAb-specific epitope) is a CD20 epitope or mimotope, e.g. SEQ ID NO: 609, SEQ ID NO: 294, or SEQ ID NO: 295, and the mAb specific for the epitope is rituximab.

In some embodiments, the step of administering a monoclonal antibody to the subject comprises infusing the subject with the monoclonal antibody. In some embodiments, the amount of epitope-specific mAb administered to the subject is sufficient to eliminate at least 20%, 30%, 40%, 50%, 60%, 70%, 80% or 90% of the CAR-expressing immune cell in the subject.

In some embodiments, the step of administering a monoclonal antibody to the subject comprises infusing the subject with 375 mg/m2 of rituximab, once or several times weekly.

In some embodiments, when immune cells expressing a CAR comprising an mAb-specific epitope (CAR-expressing immune cells) are depleted in a CDC assay using epitope-specific mAb, the amount of viable CAR-expressing immune cells decreases, e.g. by at least 10%, 20%, 30%, 40%, 50%, 60%, 70%, 80% or 90%.

In some embodiments, a cytotoxic drug is coupled to the epitope-specific mAbs which are used to deplete CAR-expressing immune cells. By combining targeting capabilities of monoclonal antibodies with the cell-killing ability of cytotoxic drugs, antibody-drug conjugate (ADC) allows a sensitive discrimination between healthy and diseased tissue when compared to the use of the drug alone. Market approvals were received for several ADCs; the technology for making them—particularly on linkers—is abundantly presented in the following prior art (Payne, G. (2003) Cancer Cell 3:207-212; Trail et al (2003) Cancer Immunol. Immunother. 52:328-337; Syrigos and Epenetos (1999) Anticancer Research 19:605-614; Niculescu-Duvaz and Springer (1997) Adv. Drug Del. Rev. 26:151-172; U.S. Pat. No. 4,975,278).

In some embodiments, the epitope-specific mAb to be infused is conjugated beforehand with a molecule able to promote complement dependent cytotoxicity (CDC). Therefore, the complement system helps or complements the ability of antibodies to clear pathogens from the organism. When stimulated by one of several, is triggered an activation cascade as a massive amplification of the response and activation of the cell-killing membrane attack complex. Different molecule may be used to conjugate the mAb, such as glycans [Courtois, A, Gac-Breton, S., Berthou, C, Guezennec, J., Bordron, A. and Boisset, C. (2012), Complement dependent cytotoxicity activity of therapeutic antibody fragments is acquired by immunogenic glycan coupling, Electronic Journal of Biotechnology ISSN: 0717-3458; http://www.ejbiotechnology.info DOI: 10.2225/voll5-issue5).

Kits

The disclosure also provides kits for use in the instant methods. Kits of the disclosure include one or more containers comprising a polynucleotide encoding a CD70-specific CAR, or an engineered immune cell comprising a polynucleotide encoding a CD70-specific CAR as described herein, and instructions for use in accordance with any of the methods of the disclosure described herein. Generally, these instructions comprise a description of administration of the engineered immune cell for the above described therapeutic treatments. The kit may include one or more agents for lymphodepletion (e.g. alemtuzumab, cytoxan, fludarabine, cyclophosphamide, or temozolomide).

The instructions relating to the use of the engineered immune cells as described herein generally include information as to dosage, dosing schedule, and route of administration for the intended treatment. The containers may be unit doses, bulk packages (e.g., multi-dose packages) or sub-unit doses. Instructions supplied in the kits of the disclosure are typically written instructions on a label or package insert (e.g., a paper sheet included in the kit), but machine-readable instructions (e.g., instructions carried on a magnetic or optical storage disk) are also acceptable. In some embodiments, the containers are identifiable (e.g., by label, barcode, or radio-frequency identification (RFID)), trackable, or imprinted with a machine-readable container identifier.

The kits of this disclosure are in suitable packaging. Suitable packaging includes, but is not limited to, vials, bottles, jars, flexible packaging (e.g., sealed Mylar or plastic bags), and the like. In some embodiments, the container (e.g., plastic bag) is suitable for intravenous infusion. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle). The container may also have a sterile access port (for example the container may be an intravenous solution bag or a vial having a stopper pierceable by a hypodermic injection needle). At least one active agent in the composition is a CD70-specific CAR. The container may further comprise a second pharmaceutically active agent.

Kits may optionally provide additional components such as buffers and interpretive information. Normally, the kit comprises a container and a label or package insert(s) on or associated with the container.

The following examples are offered for illustrative purposes only, and are not intended to limit the scope of the disclosure in any way. Indeed, various modifications of the disclosure in addition to those shown and described herein will become apparent to those skilled in the art from the foregoing description and fall within the scope of the appended claims.

The deposit was made under the provisions of the Budapest Treaty on the International Recognition of the Deposit of Microorganisms for the Purpose of Patent Procedure and Regulations thereunder (Budapest Treaty). This assures maintenance of a viable culture of the deposit for 30 years from the date of deposit. The deposit will be made available by ATCC under the terms of the Budapest Treaty, and subject to an agreement between Pfizer, Inc. and ATCC, which assures permanent and unrestricted availability of the progeny of the culture of the deposit to the public upon issuance of the pertinent U.S. patent or upon laying open to the public of any U.S. or foreign patent application, whichever comes first, and assures availability of the progeny to one determined by the U.S. Commissioner of Patents and Trademarks to be entitled thereto according to 35 U.S.C. Section 122 and the Commissioner's rules pursuant thereto (including 37 C.F.R. Section 1.14 with particular reference to 886 OG 638).

The assignee of the present application has agreed that if a culture of the materials on deposit should die or be lost or destroyed when cultivated under suitable conditions, the materials will be promptly replaced on notification with another of the same. Availability of the deposited material is not to be construed as a license to practice the disclosure in contravention of the rights granted under the authority of any government in accordance with its patent laws.

EXAMPLES

Example 1. Generation of CD70-Specific CAR-T Cells

The following codon-optimized CD70 CAR sequences listed in Table 5 below were, synthesized and subcloned into the following lentiviral vectors pLVX-EF1a-TurboGFP-P2A-CD70 CAR (Clontech) or pCLS-EF1a-BFP-P2A-CD70 CAR (Cellectis) using the XmaI (5') and MluI (3') restriction sites (thus cloning the CAR following the P2A site).

TABLE 5

Exemplary CD70-specific CARs

| CAR | CAR Amino Acid Sequence | Components |
|---|---|---|
| 31H1 | MALPVTALLLPLALLLHAARPQVQLVQSGAEVKK<br>PGSSVKVSCKASGGTFSSYGFSWVRQAPGQGLEW<br>MGGIIPIFGSANYAQKFQGRVTITADKSTSTVYME<br>LISLRSEDTAVYYCARGGSSSPFAYWGQGTLVTVS<br>SGGGGSGGGGSGGGGSGGGGSDIVMTQNPLSSPVT<br>LGQPASISCRSSQSLVHSDGNTYLSWLQQRPGQSP<br>RLLIYKISNRFSGVPDRFSGSGAGTDFTLKISRVEA<br>EDVGVYYCMQATQFPLTIGGGSKVEIKTTTPAPRP<br>PTPAPTIASQPLSLRPEACRPAAGGAVHTRGLDFAC<br>DIYIWAPLAGTCGVLLLSLVITLYCKRGRKKLLYIF<br>KQPFMRPVQTTQEEDGCSCRFPEEEEGGCELRVKF<br>SRSADAPAYQQGQNQLYNELNLGRREEYDVLDKR<br>RGRDPEMGGKPRRKNPQEGLYNELQKDKMAEAY<br>SEIGMKGERRRGKGHDGLYQGLSTATKDTYDALH<br>MQALPPR<br>(SEQ ID NO: 311) | CD8α signal peptide;<br>31H1 VH;<br>GS linker;<br>31H1 VL;<br>GS linker;<br>CD8α hinge;<br>CD8α TM domain;<br>41BB ISD;<br>CD3ζ ISD |
| 63B2 | MALPVTALLLPLALLLHAARPQVQLVQSGAEVKK<br>PGSSVKVSCKASGGTFSSYGFSWVRQAPGQGLEW<br>MGGIIPIFGTANYAQKFQGRVTITADKSTSTVFME<br>LISLRSEYTAVYYCARGGSSSPFAYWGQGTLVTVS<br>SGGGGSGGGGSGGGGSGGGGSDIVMTQTPLSSPVT<br>LGQPASISCRSSQSLVHSDGNTYLSWLQQRPGQSP | CD8α signal peptide;<br>63B2 VH;<br>GS linker;<br>63B2 VL;<br>GS linker;<br>CD8α hinge; |

TABLE 5-continued

Exemplary CD70-specific CARs

| CAR | CAR Amino Acid Sequence | Components |
|---|---|---|
| | RLLIYKISNRFSGVPDRFSGSGAGTDFTLKISRVEA<br>EDVGVYYCMQATQFPLTIGGGSKVEIK<br>TTTPAPRPPTPAPTIASQPLSLRPEACRPAAGGAVH<br>TRGLDFACDIYIWAPLAGTCGVLLLSLVITLYCKRG<br>RKKLLYIFKQPFMRPVQTTQEEDGCSCRFPEEEEGG<br>CELRVKFSRSADAPAYQQGQNQLYNELNLGRREE<br>YDVLDKRRGRDPEMGGKPRRKNPQEGLYNELQK<br>DKMAEAYSEIGMKGERRRGKGHDGLYQGLSTATK<br>DTYDALHMQALPPR<br>(SEQ ID NO: 312) | CD8α TM domain;<br>41BB ISD;<br>CD3ζ ISD |
| 40E3 | MALPVTALLLPLALLLHAARPQVQLQESGPGLVKP<br>SETLSLTCTVSGGSISSYYWNWIRQPPGKGLEWIG<br>YIYYSGSTNYNPSLKSRVTISVDTSKNQFSLKLRSV<br>TAADTAVYYCARDIRTWGQGTLVTVSSGGGGSG<br>GGGSGGGGSGGGGSDIQMTQSPSSLSASVGDRVTI<br>TCRASQGISNYLAWFQQKPGKAPKSLIYAASSLQS<br>GVPSKFSGSGSGTDFTLTISSLQPEDFATYYCQQYN<br>SYPLTFGGGTKVEIKTTTPAPRPPTPAPTIASQPLSL<br>RPEACRPAAGGAVHTRGLDFACDIYIWAPLAGTCG<br>VLLLSLVITLYCKRGRKKLLYIFKQPFMRPVQTTQE<br>EDGCSCRFPEEEEGGCELRVKFSRSADAPAYQQGQ<br>NQLYNELNLGRREEYDVLDKRRGRDPEMGGKPRR<br>KNPQEGLYNELQKDKMAEAYSEIGMKGERRRGKG<br>HDGLYQGLSTATKDTYDALHMQALPPR<br>(SEQ ID NO: 313) | CD8α signal peptide;<br>40E3 VH;<br>GS linker;<br>40E3 VL;<br>GS linker;<br>CD8α hinge;<br>CD8α TM domain;<br>41BB ISD;<br>CD3ζ ISD |
| 42C3 | MALPVTALLLPLALLLHAARPEVQLVESGGGLVQP<br>GGSLRLSCAASGFTFRNSWMSWVRQAPGKGLEW<br>VANIKRDGSEKYYVDSVKGRFTISRDNAKNSLYL<br>QMNSLRAEDTAVYYCARDQTGSFDYWGQGTLVT<br>VSSGGGGSGGGGSGGGGSGGGGSDVVMTQSPLSL<br>PVTLGQPASISCRSSQSLVYSDENTYLNWFQQRPG<br>QSLRRLIYQVSNRDSGVPDRFSGSGSGTDFTLKISR<br>VEAEDVGVYFCMQGTYWPPTFGGGTKVEIKTTTP<br>APRPPTPAPTIASQPLSLRPEACRPAAGGAVHTRGL<br>DFACDIYIWAPLAGTCGVLLLSLVITLYCKRGRKK<br>LLYIFKQPFMRPVQTTQEEDGCSCRFPEEEEGGCEL<br>RVKFSRSADAPAYQQGQNQLYNELNLGRREEYDV<br>LDKRRGRDPEMGGKPRRKNPQEGLYNELQKDKM<br>AEAYSEIGMKGERRRGKGHDGLYQGLSTATKDTY<br>DALHMQALPPR<br>(SEQ ID NO: 314) | CD8α signal peptide;<br>42C3 VH;<br>GS linker;<br>42C3 VL;<br>GS linker;<br>CD8α hinge;<br>CD8α TM domain;<br>41BB ISD;<br>CD3ζ ISD |
| 45F11 | MALPVTALLLPLALLLHAARPQVQLRGSGPGLVKP<br>SETLSLTCTVSDDSISVYYWSWIRQPAGKGLEWIG<br>RVYSSGNINYNPSLESRVTMSVDTSKSRFSLNLSSV<br>TAADTAVYYCARGLDAFDIWGQGTMVTVSSGGG<br>GSGGGGSGGGGSGGGGSEIVMTQSPATLSMSLGER<br>ATLSCRASQSVSSSLAWYQQKPGQAPRLLIYGAST<br>RATGIPARFGGSGSGTEFTLTISSLQSEDFAVYYCQ<br>QYINWPHFGGGTKVEIKTTTPAPRPPTPAPTIASQP<br>LSLRPEACRPAAGGAVHTRGLDFACDIYIWAPLAG<br>TCGVLLLSLVITLYCKRGRKKLLYIFKQPFMRPVQT<br>TQEEDGCSCRFPEEEEGGCELRVKFSRSADAPAYQ<br>QGQNQLYNELNLGRREEYDVLDKRRGRDPEMGG<br>KPRRKNPQEGLYNELQKDKMAEAYSEIGMKGERR<br>RGKGHDGLYQGLSTATKDTYDALHMQALPPR<br>(SEQ ID NO: 315) | CD8α signal peptide;<br>45F11 VH;<br>GS linker;<br>45F11 VL;<br>GS linker;<br>CD8α hinge;<br>CD8α TM domain;<br>41BB ISD;<br>CD3ζ ISD |
| 64F9 | MALPVTALLLPLALLLHAARPEVQLLESGGGLVQP<br>GESLRLSCEVSGFTFTSYAMSWVRQVPGKGLEWV<br>SIISGVAFTTYYADSVKGRFTISRDHSKNTLYLQMN<br>GLRAEDTAVYYCVKVDGEVYWGQGTLVTVSSGG<br>GGSGGGGSGGGGSGGGGSDIQMTQSPSSLSASVGD<br>RVTITCQASQDISNYLNWYQQKPGKAPKILIYGAS<br>NLETGVPSRFSGSGSGTDFTFAISSLQPEDVATYYC<br>QQYDNFPITFGQGTRLEIKTTTPAPRPPTPAPTIASQ<br>PLSLRPEACRPAAGGAVHTRGLDFACDIYIWAPLA<br>GTCGVLLLSLVITLYCKRGRKKLLYIFKQPFMRPV<br>QTTQEEDGCSCRFPEEEEGGCELRVKFSRSADAPA<br>YQQGQNQLYNELNLGRREEYDVLDKRRGRDPEM<br>GGKPRRKNPQEGLYNELQKDKMAEAYSEIGMKGE<br>RRRGKGHDGLYQGLSTATKDTYDALHMQALPPR<br>(SEQ ID NO: 316) | CD8α signal peptide;<br>64F9 VH;<br>GS linker;<br>64F9 VL;<br>GS linker;<br>CD8α hinge;<br>CD8α TM domain;<br>41BB ISD;<br>CD3ζ ISD |

TABLE 5-continued

Exemplary CD70-specific CARs

| CAR | CAR Amino Acid Sequence | Components |
|---|---|---|
| 72C2 | MALPVTALLLPLALLLHAARPQVQLVQSGAEVKK PGSSVKVSCEASGGTFITYAISWVRQAPGQGLEW MGGIIPFFGTANYAQKFQGRVTITADKSTSTASME LRSLRSEDTAMYYCAQWELFFFDFWGQGTPVTVS SGGGGSGGGGSGGGGSGGGGSEIVMTQSPDTLSVS PGERAILSCRASQSVSSNLAWYQQKPGQAPRLLIY SASTRASGIPARFSGSGSGTEFTLSISSLQSEDFAVY YCQQYDNWPPLTFGGGTKVEIKTTTPAPRPPTPAP TIASQPLSLRPEACRPAAGGAVHTRGLDFACDIYIW APLAGTCGVLLLSLVITLYCKRGRKKLLYIFKQPFM RPVQTTQEEDGCSCRFPEEEEGGCELRVKFSRSAD APAYQQGQNQLYNELNLGRREEYDVLDKRRGRDP EMGGKPRRKNPQEGLYNELQKDKMAEAYSEIGM KGERRRGKGHDGLYQGLSTATKDTYDALHMQAL PPR (SEQ ID NO: 317) | CD8α signal peptide; 72C2 VH; GS linker; 72C2 VL; GS linker; CD8α hinge; CD8α TM domain; 41BB ISD; CD3ζ ISD |
| 2F10 | MALPVTALLLPLALLLHAARPAVQLVESGGGLVQP GGSLRLSCAASGFTFTYYSMNWVRQAPGKGLEW VSHISIRSSTIYFADSAKGRFTISRDNAKNSLYLQM NSLRDEDTAVYYCARGSGWYGDYFDYWQGTL VTVSSGGGGSGGGGSGGGGSGGGGSEIVLTQSPGT LSLSPGERATLSCRASQSVSSSYLAWYQQQPGQAP RLLIYGASSRATGIPDRFSGSGSGTDFTLTISRLEPE DFAIYYCQQYGSSPLTFGGGTKVEIK TTTPAPRPPTPAPTIASQPLSLRPEACRPAAGGAVH TRGLDFACDIYIWAPLAGTCGVLLLSLVITLYCKRG RKKLLYIFKQPFMRPVQTTQEEDGCSCRFPEEEGG CELRVKFSRSADAPAYQQGQNQLYNELNLGRREE YDVLDKRRGRDPEMGGKPRRKNPQEGLYNELQK DKMAEAYSEIGMKGERRRGKGHDGLYQGLSTATK DTYDALHMQALPPR (SEQ ID NO: 318) | CD8α signal peptide; 2F10 VH; GS linker; 2F10 VL; GS linker; CD8α hinge; CD8α TM domain; 41BB ISD; CD3ζ ISD |
| 4F11 | MALPVTALLLPLALLLHAARPQVTLKESGPVLVKP TETLTLTCTVSGFSLSNARMGVTWIRQPPGKALE WLAHIFSNDEKSYSTSLKSRLTISKDTSKTQVVLTM TNMDPVDTATYYCARIRDYYDISSYYDYWGQGTL VSVSSGGGGSGGGGSGGGGSGGGGSDIQMTQSPS AMSASVGDRVTITCRASQDISNYLAWFQQKPGKV PKRLIYAASSLQSGVPSRFSGSGSGTEFTLTISSLLPE DFATYYCLQLNSFPFTFGGGTKVEIN TTTPAPRPPTPAPTIASQPLSLRPEACRPAAGGAVH TRGLDFACDIYIWAPLAGTCGVLLLSLVITLYCKRG RKKLLYIFKQPFMRPVQTTQEEDGCSCRFPEEEGG CELRVKFSRSADAPAYQQGQNQLYNELNLGRREE YDVLDKRRGRDPEMGGKPRRKNPQEGLYNELQK DKMAEAYSEIGMKGERRRGKGHDGLYQGLSTATK DTYDALHMQALPPR (SEQ ID NO: 319) | CD8α signal peptide; 4F11 VH; GS linker; 4F11 VL; GS linker; CD8α hinge; CD8α TM domain; 41BB ISD; CD3ζ ISD |
| 10H10 | MALPVTALLLPLALLLHAARPEVQLVESGGGLVQP GGSLRLSCAVSGFTFSNHNIHWVRQAPGKGLEWIS YISRSSSTIYYADSVKGRFTISRDNAKNSLYLQMNS LRDEDTAVYYCARDHAQWYGMDVWGQGTTVTV SSGGGGSGGGGSGGGGSGGGGSDIQMTQSPSSVSA SVGDRVTITCRASQGISSWLAWYQQKPGKAPKVL IYAASSLQSGVPSRFSGSGSGTDFTLTISSLQPEDFA TYYCQQAFSFPFTFGPGTKVDIKTTTPAPRPPTPAP TIASQPLSLRPEACRPAAGGAVHTRGLDFACDIYIW APLAGTCGVLLLSLVITLYCKRGRKKLLYIFKQPFM RPVQTTQEEDGCSCRFPEEEEGGCELRVKFSRSAD APAYQQGQNQLYNELNLGRREEYDVLDKRRGRDP EMGGKPRRKNPQEGLYNELQKDKMAEAYSEIGM KGERRRGKGHDGLYQGLSTATKDTYDALHMQAL PPR (SEQ ID NO: 320) | CD8α signal peptide; 10H10 VH; GS linker; 10H10 VL; GS linker; CD8α hinge; CD8α TM domain; 41BB ISD; CD3ζ ISD |
| 17G6 | MALPVTALLLPLALLLHAARPEVQLVESGGGLVQP GGSLRLSCVASGFTFSSYWMSWVRQAPGKGLEW VASIKQDGSEKYYVDSVKGRFTISRDNAKNSVYL QMNSLRAEDTGVYYCAREGVNWGWRLYWHFD LWGRGTLVTVSSGGGGSGGGGSGGGGSGGGGSDI VMTQSPDSLAVSLGERATINCKSSQSVLYSNNKN YVAWYQQKPGQPPNLLIFWASTRESGVPDRFSGS GSGTDFTLTISSLQAEDVAVYYCQQYYSTLTFGGG | CD8α signal peptide; 17G6 VH; GS linker; 17G6 VL; GS linker; CD8α hinge; CD8α TM domain; 41BB ISD; |

TABLE 5-continued

Exemplary CD70-specific CARs

| CAR | CAR Amino Acid Sequence | Components |
|---|---|---|
| | TKVEIKTTTPAPRPPTPAPTIASQPLSLRPEACRPAA GGAVHTRGLDFACDIYIWAPLAGTCGVLLLSLVIT LYCKRGRKKLLYIFKQPFMRPVQTTQEEDGCSCRF PEEEEGGCELRVKFSRSADAPAYQQGQNQLYNEL NLGRREEYDVLDKRRGRDPEMGGKPRRKNPQEGL YNELQKDKMAEAYSEIGMKGERRRGKHDGLYQ GLSTATKDTYDALHMQALPPR (SEQ ID NO: 321) | CD3ζ ISD |
| 65E11 | MALPVTALLLPLALLLHAARPEVQVVESGGGLVQP GGSLRLSCAASGFTFSSYSMNWVRQAPGKGLEWV SHSSISRGNIYFADSVKGRFTISRDNAKNSLYLQMN SLRDEDTAVYYCARGSGWYGDYFDYWGQGTLVT VSSGGGGSGGGGSGGGGSGGGGSEIVLTQSPGTLS LSPGERVTLSCRASQSVSSSYLAWYQQKPGQAPRL LIYDASSRATGIPDRFSGSGSGTDFTLTISRLEPEDF AVYYCQQYGSSPLTFGGGTKVEIKTTTPAPRPPTP APTIASQPLSLRPEACRPAAGGAVHTRGLDFACDIY IWAPLAGTCGVLLLSLVITLYCKRGRKKLLYIFKQP FMRPVQTTQEEDGCSCRFPEEEEGGCELRVKFSRS ADAPAYQQGQNQLYNELNLGRREEYDVLDKRRG RDPEMGGKPRRKNPQEGLYNELQKDKMAEAYSEI GMKGERRRGKHDGLYQGLSTATKDTYDALHMQ ALPPR (SEQ ID NO: 322) | CD8α signal peptide; 65E11 VH; GS linker; 65E11 VL; GS linker; CD8α hinge; CD8α TM domain; 41BB ISD; CD3ζ ISD |
| P02B10 | MALPVTALLLPLALLLHAARPEVQLLESGGGLVQP GGSLRLSCAASGFAFSNYAMSWVRQAPGKGLEW VSAIRGGGGSTYYADSVKGRFTISRDNSKNTLYLQ MNSLRAEDTAVYYCARDFISGTWYPDYWGQGTL VTVSSGGGGSGGGGSGGGGSGGGGSELQSVLTQPP SASGTPGQRVTISCSGSSSNIGSNYVYWYQQLPGT APKLLIYRNNQRPSGVPDRFSGSKSGTSASLAISGL RSEDEADYYCAAWDDSLSGVVFGGGTKLTVLTTT PAPRPPTPAPTIASQPLSLRPEACRPAAGGAVHTRG LDFACDIYIWAPLAGTCGVLLLSLVITLYCKRGRK KLLYIFKQPFMRPVQTTQEEDGCSCRFPEEEEGGCE LRVKFSRSADAPAYQQGQNQLYNELNLGRREEYD VLDKRRGRDPEMGGKPRRKNPQEGLYNELQKDK MAEAYSEIGMKGERRRGKHDGLYQGLSTATKDT YDALHMQALPPR (SEQ ID NO: 323) | CD8α signal peptide; P02B10 VH; GS linker; P02B10 VL; GS linker; CD8α hinge; CD8α TM domain; 41BB ISD; CD3ζ ISD |
| P07D03 | MALPVTALLLPLALLLHAARPEVQLVQSGAEVKKP GESLKISCKGSGYRFTSYWIGWVRQMPGKGLEW MGSIYPDDSDTRYSPSFQGQVTISADKSISTAYLQW SSLKASDTAMYYCASSTVDYPGYSYFDYWGQGTL VTVSSGGGGSGGGGSGGGGSGGGGSELQSVLTQPP SASGTPGQRVTISCSGSRSNIGSNYVYWYQQLPGT APKLLIYRNNQRPSGVPDRFSGSKSGTSASLAISGL RSEDEADYYCASWDGSLSAVVFGTGTKLTVLTTT PAPRPPTPAPTIASQPLSLRPEACRPAAGGAVHTRG LDFACDIYIWAPLAGTCGVLLLSLVITLYCKRGRK KLLYIFKQPFMRPVQTTQEEDGCSCRFPEEEEGGCE LRVKFSRSADAPAYQQGQNQLYNELNLGRREEYD VLDKRRGRDPEMGGKPRRKNPQEGLYNELQKDK MAEAYSEIGMKGERRRGKHDGLYQGLSTATKDT YDALHMQALPPR (SEQ ID NO: 324) | CD8α signal peptide; P07D03 VH; GS linker; P07D03 VL; GS linker; CD8α hinge; CD8α TM domain; 41BB ISD; CD3ζ ISD |
| P08A02 | MALPVTALLLPLALLLHAARPEVQLVQSGAEVKKP GESLKISCKGSGYTFTNYWIAWVRQMPGKGLEW MGIIYPDGSDTRYSPSFQGQVTISADKSISTAYLQW SSLKASDTAMYYCARDITSWYYGEPAFDIWGQGT LVTVSSGGGGSGGGGSGGGGSGGGGSELQSVLTQ PPSASGTPGQRVTISCSGSSSNIGSNYVYWYQQLPG TAPKLLIYRNNQRPSGVPDRFSGSKSGTSASLAISG LRSEDEADYYCATWDDSLGSPVFGTGTKLTVLTT TPAPRPPTPAPTIASQPLSLRPEACRPAAGGAVHTR GLDFACDIYIWAPLAGTCGVLLLSLVITLYCKRGR KKLLYIFKQPFMRPVQTTQEEDGCSCRFPEEEEGGC ELRVKFSRSADAPAYQQGQNQLYNELNLGRREEY DVLDKRRGRDPEMGGKPRRKNPQEGLYNELQKD KMAEAYSEIGMKGERRRGKHDGLYQGLSTATKD TYDALHMQALPPR (SEQ ID NO: 325) | CD8α signal peptide; P08A02 VH; GS linker; P08A02 VL; GS linker; CD8α hinge; CD8α TM domain; 41BB ISD; CD3ζ ISD |

TABLE 5-continued

Exemplary CD70-specific CARs

| CAR | CAR Amino Acid Sequence | Components |
|---|---|---|
| P08E02 | MALPVTALLLPLALLLHAARPEVQLVQSGAEVKKP GESLKISCKGSGYSFTSSWIGWVRQMPGKGLEWM GIIYPGDSDTRYSPSFQGQVTISADKSISTAYLQWSS LKASDTAMYYCAKGLSQAMTGFGFDYWGQGTL VTVSSGGGGSGGGGSGGGGSGGGGSELDIQMTQS PSSLSASVGDRVTITCRASQSISRYLNWYQQKPGK APKLLIYAASILQTGVPSRFSGSGSGTDFTLTISSLQ PEDFATYYCQQSYSTTMWTFGQGTKVEIKTTTPA PRPPTPAPTIASQPLSLRPEACRPAAGGAVHTRGLD FACDIYIWAPLAGTCGVLLLSLVITLYCKRGRKKLL YIFKQPFMRPVQTTQEEDGCSCRFPEEEEGGCELRV KFSRSADAPAYQQGQNQLYNELNLGRREEYDVLD KRRGRDPEMGGKPRRKNPQEGLYNELQKDKMAE AYSEIGMKGERRRGKGHDGLYQGLSTATKDTYDA LHMQALPPR<br>(SEQ ID NO: 326) | CD8α signal peptide; P08E02 VH; GS linker; P08E02 VL; GS linker; CD8α hinge; CD8α TM domain; 41BB ISD; CD3ζ ISD |
| P08F08 | MALPVTALLLPLALLLHAARPEVQLVQSGAEVKKP GESLKISCKGSGYGFTSYWIGWVRQMPGKGLEW MGIIHPDDSDTKYSPSFQGQVTISADKSISTAYLQW SSLKASDTAMYYCASSYLRGLWGGYFDYWGQGT LVTVSSGGGGSGGGGSGGGGSGGGGSELQSVLTQ PPSASGTPGQRVTISCSGSSSNIGSNYVNWYQQLPG TAPKLLIYGDYQRPSGVPDRFSGSKSGTSASLAISG LRSEDEADYYCATRDDSLSGSVVFGTGTKLTVLTT TPAPRPPTPAPTIASQPLSLRPEACRPAAGGAVHTR GLDFACDIYIWAPLAGTCGVLLLSLVITLYCKRGR KKLLYIFKQPFMRPVQTTQEEDGCSCRFPEEEEGGC ELRVKFSRSADAPAYQQGQNQLYNELNLGRREEY DVLDKRRGRDPEMGGKPRRKNPQEGLYNELQKD KMAEAYSEIGMKGERRRGKGHDGLYQGLSTATKD TYDALHMQALPPR<br>(SEQ ID NO: 327) | CD8α signal peptide; P08F08 VH; GS linker; P08F08 VL; GS linker; CD8α hinge; CD8α TM domain; 41BB ISD; CD3ζ ISD |
| P08G02 | MALPVTALLLPLALLLHAARPEVQLVQSGAEVKKP GESLKISCKGSGYTFPSSWIGWVRQMPGKGLEWM GIIYPDTSHTRYSPSFQGQVTISADKSISTAYLQWSS LKASDTAMYYCARASYFDRGTGYSSWWMDVWG QGTLVTVSSGGGGSGGGGSGGGGSGGGGSELDIQ MTQSPSSLSASVGDRVTITCRASQSIYDYLHWYQQ KPGKAPKLLIYDASNLQSGVPSRFSGSGSGTDFTLT ISSLQPEDFATYYCQQSYTTPLFTFGQGTKVEIKTT TPAPRPPTPAPTIASQPLSLRPEACRPAAGGAVHTR GLDFACDIYIWAPLAGTCGVLLLSLVITLYCKRGR KKLLYIFKQPFMRPVQTTQEEDGCSCRFPEEEEGGC ELRVKFSRSADAPAYQQGQNQLYNELNLGRREEY DVLDKRRGRDPEMGGKPRRKNPQEGLYNELQKD KMAEAYSEIGMKGERRRGKGHDGLYQGLSTATKD TYDALHMQALPPR<br>(SEQ ID NO: 328) | CD8α signal peptide; P08G02 VH; GS linker; P08G02 VL; GS linker; CD8α hinge; CD8α TM domain; 41BB ISD; CD3ζ ISD |
| P12B09 | MALPVTALLLPLALLLHAARPEVQLLESGGGLVQP GGSLRLSCAASGFTFSQYSMSWVRQAPGKGLEWV SAISGGGVSTYYADSVKGRFTISRDNSKNTLYLQM NSLRAEDTAVYYCASDISDSGGSHWYFDYWGQG TLVTVSSGGGGSGGGGSGGGGSGGGGSELDIQMT QSPSSLSASVGDRVTITCRASQYIGRYLNWYQQKR GKAPKLLIHGATSLASGVPSRFSGSGSGTDFTLTISS LQPEDFATYYCQQSYSTTSPTFGQGTKVEIKTTTP APRPPTPAPTIASQPLSLRPEACRPAAGGAVHTRGL DFACDIYIWAPLAGTCGVLLLSLVITLYCKRGRKK LLYIFKQPFMRPVQTTQEEDGCSCRFPEEEEGGCEL RVKFSRSADAPAYQQGQNQLYNELNLGRREEYDV LDKRRGRDPEMGGKPRRKNPQEGLYNELQKDKM AEAYSEIGMKGERRRGKGHDGLYQGLSTATKDTY DALHMQALPPR<br>(SEQ ID NO: 329) | CD8α signal peptide; P12B09 VH; GS linker; P12B09 VL; GS linker; CD8α hinge; CD8α TM domain; 41BB ISD; CD3ζ ISD |
| P12F02 | MALPVTALLLPLALLLHAARPEVQLLESGGGLVQP GGSLRLSCAASGFTFSSYAMSWVRQAPGKGLEWV STISGTGGTTYYADSVKGRFTISRDNSKNTLYLQM NSLRAEDTAVYYCAKVRAGIDPTASDVWGQGTL VTVSSGGGGSGGGGSGGGGSGGGGSELQSVLTQPP SASGTPGQRVTISCSGSTSNIGRNYVYWYQQLPGT APKLLIYRTNQRPSGVPDRFSGSKSGTSASLAISGL | CD8α signal peptide; P12F02 VH; GS linker; P12F02 VL; GS linker; CD8α hinge; CD8α TM domain; |

TABLE 5-continued

Exemplary CD70-specific CARs

| CAR | CAR Amino Acid Sequence | Components |
|---|---|---|
| | RSEDEADYYAAWDDSLSGRVFGTGTKLTVLTTT<br>PAPRPPTPAPTIASQPLSLRPEACRPAAGGAVHTRG<br>LDFACDIYIWAPLAGTCGVLLLSLVITLYCKRGRK<br>KLLYIFKQPFMRPVQTTQEEDGCSCRFPEEEEGGCE<br>LRVKFSRSADAPAYQQGQNQLYNELNLGRREEYD<br>VLDKRRGRDPEMGGKPRRKNPQEGLYNELQKDK<br>MAEAYSEIGMKGERRRGKGHDGLYQGLSTATKDT<br>YDALHMQALPPR<br>(SEQ ID NO: 330) | 41BB ISD;<br>CD3ζ ISD |
| P12G07 | MALPVTALLLPLALLLHAARPEVQLLESGGGLVQP<br>GGSLRLSCAASGFTFNNFAMSWVRQAPGKGLEW<br>VSGISGSGDNTYYADSVKGRFTISRDNSKNTLYLQ<br>MNSLRAEDTAVYYCAKDRDIGLGWYSYYLDVW<br>GQGTLVTVSSGGGGSGGGGSGGGGSGGGGSELQS<br>VLTQPPSASGTPGQRVTISCSGSSSNIGSNYVYWYQ<br>QLPGTAPKPLIYMNNQRPSGVPDRFSGSKSGTSAS<br>LAISGLRSEDEADYYCAAWDDSLSAVVFGTGTKL<br>TVLTTTPAPRPPTPAPTIASQPLSLRPEACRPAAGGA<br>VHTRGLDFACDIYIWAPLAGTCGVLLLSLVITLYCK<br>RGRKKLLYIFKQPFMRPVQTTQEEDGCSCRFPEEEE<br>GGCELRVKFSRSADAPAYQQGQNQLYNELNLGRR<br>EEYDVLDKRRGRDPEMGGKPRRKNPQEGLYNELQ<br>KDKMAEAYSEIGMKGERRRGKGHDGLYQGLSTAT<br>KDTYDALHMQALPPR<br>(SEQ ID NO: 331) | CD8α signal peptide;<br>P12G07 VH;<br>GS linker;<br>P12G07 VL;<br>GS linker;<br>CD8α hinge;<br>CD8α TM domain;<br>41BB ISD;<br>CD3ζ ISD |
| P13F04 | MALPVTALLLPLALLLHAARPQVQLVQSGAEVKK<br>PGSSVKVSCKASGGTFSSYAISWVRQAPGQGLEW<br>MGEIIPIFGTASYAQKFQGRVTITADESTSTAYMEL<br>SSLRSEDTAVYYCARAGWDDSWFDYWGQGTLVT<br>VSSGGGGSGGGGSGGGGSGGGGSELQSVLTQPPSA<br>SGTPGQRVTISCSGSNSNIGTNYVSWYQQLPGTAP<br>KLLIYRSSRRPSGVPDRFSGSKSGTSASLAISGLRSE<br>DEADYYCAAWDGSLSGHWVFGTGTKLTVLTTTP<br>APRPPTPAPTIASQPLSLRPEACRPAAGGAVHTRGL<br>DFACDIYIWAPLAGTCGVLLLSLVITLYCKRGRKK<br>LLYIFKQPFMRPVQTTQEEDGCSCRFPEEEEGGCEL<br>RVKFSRSADAPAYQQGQNQLYNELNLGRREEYDV<br>LDKRRGRDPEMGGKPRRKNPQEGLYNELQKDKM<br>AEAYSEIGMKGERRRGKGHDGLYQGLSTATKDTY<br>DALHMQALPPR<br>(SEQ ID NO: 332) | CD8α signal peptide;<br>P13F04 VH;<br>GS linker;<br>P13F04 VL;<br>GS linker;<br>CD8α hinge;<br>CD8α TM domain;<br>41BB ISD;<br>CD3ζ ISD |
| P15D02 | MALPVTALLLPLALLLHAARPEVQLVQSGAEVKKP<br>GESLKISCKGSGYSFASYWIGWVRQMPGKGLEWM<br>GVIYPGTSETRYSPSFQGQVTISADKSISTAYLQWS<br>SLKASDTAMYYCAKGLSASASGYSFQYWGQGTL<br>VTVSSGGGGSGGGGSGGGGSGGGGSELDIQMTQS<br>PSSLSASVGDRVTITCRASQSIDTYLNWYQQKPGK<br>APKLLIYSASSLHSGVPSRFSGSGSGTDFTLTISSLQ<br>PEDFATYYCQQSYSTTAWTFGQGTKVEIKTTTPAP<br>RPPTPAPTIASQPLSLRPEACRPAAGGAVHTRGLDF<br>ACDIYIWAPLAGTCGVLLLSLVITLYCKRGRKKLL<br>YIFKQPFMRPVQTTQEEDGCSCRFPEEEEGGCELRV<br>KFSRSADAPAYQQGQNQLYNELNLGRREEYDVLD<br>KRRGRDPEMGGKPRRKNPQEGLYNELQKDKMAE<br>AYSEIGMKGERRRGKGHDGLYQGLSTATKDTYDA<br>LHMQALPPR<br>(SEQ ID NO: 333) | CD8α signal peptide;<br>P15D02 VH;<br>GS linker;<br>P15D02 VL;<br>GS linker;<br>CD8α hinge;<br>CD8α TM domain;<br>41BB ISD;<br>CD3ζ ISD |
| P16C05 | MALPVTALLLPLALLLHAARPEVQLVQSGAEVKKP<br>GESLKISCKGSGYSFTDYWIGWVRQMPGKGLEW<br>MGMISPGGSTTIYRPSFQGQVTISADKSISTAYLQW<br>SSLKASDTAMYYCAREMYTGGYGGSWYFDYWG<br>QGTLVTVSSGGGGSGGGGSGGGGSGGGGSELDIQ<br>MTQSPSSLSASVGDRVTITCRASQSIGQSLNWYQQ<br>KPGKAPKLLIYGASSLQSGVPSRFSGSGSGTDFTLT<br>ISSLQPEDFATYYCQQSYSTPITFGQGTKVEIKTTTP<br>APRPPTPAPTIASQPLSLRPEACRPAAGGAVHTRGL<br>DFACDIYIWAPLAGTCGVLLLSLVITLYCKRGRKK<br>LLYIFKQPFMRPVQTTQEEDGCSCRFPEEEEGGCEL<br>RVKFSRSADAPAYQQGQNQLYNELNLGRREEYDV | CD8α signal peptide;<br>P16C05 VH;<br>GS linker;<br>P16C05 VL;<br>GS linker;<br>CD8α hinge;<br>CD8α TM domain;<br>41BB ISD;<br>CD3ζ ISD |

TABLE 5-continued

Exemplary CD70-specific CARs

| CAR | CAR Amino Acid Sequence | Components |
|---|---|---|
| | LDKRRGRDPEMGGKPRRKNPQEGLYNELQKDKM AEAYSEIGMKGERRRGKHDGLYQGLSTATKDTY DALHMQALPPR (SEQ ID NO: 334) | |

CARs comprising ScFv based on 10A1, 10E2, 11A1, 11C1, 11D1, 11E1, 12A2, 12C4, 12C5, 12D3, 12D6, 12D7, 12F5, 12H4, 8C8, 8F7, 8F8, 9D8, 9E10, 9E5, 9F4 or 9F8 sequences are also prepared and comprise sequences shown in SEQ ID NO: 580, 581, 582, 583, 584, 585, 586, 587, 588, 589, 590, 591, 592, 593, 594, 595, 596, 597, 598, 599, 600 and 601.

Example 2: Jurkat Screen for In Vitro Characterization of Anti-CD70 CARs

Jurkat cells are an immortalized human T cell line and much like primary T cells, express CD70 upon activation or transduction. Hence, these cells were chosen for transduction with CD70 CARs to study their activation profile. Jurkat cells modified using CRISPR/Cas9 to knockout CD70 ("KO Jurkat") or parental Jurkat ("WT Jurkat") were transduced with CD70 CARs. Their auto-activation profile was determined by comparing the percentage of CD69 expression on WT Jurkat (auto-activation and target-dependent activation since WT Jurkat express target i.e., CD70, upon transduction) versus that on KO Jurkat (auto-activation alone, in the absence of target, i.e., CD70) by flow cytometry. Clones that showed target-specific activation and minimal auto-activation were then selected based on the "Activation ratio" (please see below for definition of the term). Auto-activation is a term used to describe the target-independent clustering and activation of CARs. CAR auto-activation can range from minimal/none to high and is thought to be an inherent characteristic or tendency of the scFv to aggregate and cluster. Auto-activation leads to chronic signaling and can lead to T cell differentiation, exhaustion, and decreased cytolytic potential. Screening and elimination of highly auto-activating CARs is an essential step in optimal CAR identification. Ideal CARs have minimal auto-activation.

Binding of CARs to recombinant antigen is one way to characterize CARs and bin them into unique groups. Strong binding can be an indication that a CAR is highly expressed on the cell surface and has a moderate to high affinity for its target antigen. Low or minimal binding can indicate low expression and/or weaker affinity. CARs with high and low binding should be further characterized, as optimal affinity and cell-surface expression are unknown.

Materials and Methods:

CRISPR/Cas9 Knockout of CD70 in Jurkat Cells

Jurkat cells were transfected with CD70-targeting guide RNA vectors containing Cas9 and GFP obtained from DNA 2.0 using Lipofectamine 3000 (Invitrogen). Forty-eight hours after transfection, fluorescence activated single cell sorting was performed to select GFP+ CD70− cells. Individual clones were then expanded and genomic DNA was obtained for PCR by crude cell lysis. PCR products were sequenced to identify clones with indels or frameshifts indicating CD70 knockout.

Jurkat Cell Transduction with CD70 CARs

HEK293T cells were plated at 0.5 million cells per mL in 2 mL of DMEM (Gibco) supplemented with 10% FBS (Hyclone or JR Scientific) per well of a 6-well plate on Day 0. On Day 1, the lentivirus was prepared by mixing together lentiviral packaging vectors 1.5 ug psPAX2, 0.5 ug pMD2G, and 2 ug of the appropriate transfer CAR vector containing GFP tag in 250 uL Opti-MEM (Gibco) per well of the 6-well plate ("DNA mix"). 10 uL Lipofectamine 2000 (Invitrogen) in 250 uL Opti-MEM was incubated at room temperature for 5 minutes and then added to the DNA mix. The virus was incubated at room temperature for 20 minutes and the total volume of 500 uL was slowly added to the sides of the wells containing HEK293T. On Day 2, the media from each well of the 6-well plate was replaced with 2 mL per well of Jurkat cell media, i.e., RPMI (Gibco) supplemented with 10% FBS. On Day 3, Jurkat cells (KO or WT) were resuspended at 0.5 million cells per mL in 2 mL of RPMI supplemented with 10% FBS per well of a 6-well plate. The lentiviral supernatants from HEK293T cells were harvested and passed through a 0.45 micron filter (EMD Millipore) to remove cell debris, and then added to the Jurkat cells. On Day 6, transduction efficiency was determined by detecting GFP signal via flow cytometry. Cells were expanded into larger flasks as needed using RPMI supplemented with 10% FBS.

Activation Profile and Ability to Bind CD70 Protein

On Day 5, transduced cells were stained with human anti-CD69 antibody conjugated to PE-Cy7 and acquired on a flow cytometer to obtain percentage of CD69+ population for each CAR. Cells were also incubated with recombinant biotinylated human CD70 protein, stained with streptavidin conjugated to PE, and acquired on a flow cytometer to determine protein binding. Activation ratios (WT activation/KO activation) and protein binding were used to rank CARs.

TABLE 6

| CAR | CD69+ in WT (%) | CD69+ in KO (%) | Activation ratio (WT/KO) | Type of activation | Protein binding (%) |
|---|---|---|---|---|---|
| 31H1 | 37.2 | 16.1 | 2.31 | Auto | 1.75 |
| 63B2 | 11.1 | 1.85 | 6 | Target | 0.02 |
| 40E3 | 59.2 | 28.3 | 2.09 | Auto | 0.65 |
| 42C3 | 30.8 | 5.86 | 5.25 | Target | 1.48 |
| 45F11 | 16.4 | 2.46 | 6.67 | Target | 1.29 |
| 64F9 | 25.2 | 6.48 | 3.89 | Target | 6.24 |
| 72C2 | 7.85 | 1.27 | 6.18 | Target | 0.09 |
| 2F10 | 22.2 | 2.86 | 7.76 | Target | 0.00 |
| 4F11 | 27.6 | 2.32 | 11.90 | Target | 47.10 |
| 10H10 | 32.8 | 4.48 | 7.32 | Target | 17.90 |
| 17G6 | 78.7 | 11.5 | 6.84 | Target | 37.60 |
| 65E11 | 11.4 | 1.36 | 8.38 | Target | 0.05 |

Activation ratio and protein binding of hybridoma CARs were determined in the Jurkat screen and used for in vitro characterization of CARs. Activation ratio was determined by calculating the ratio of the percentage of CD69 expression on WT Jurkat cells transduced with CD70 CAR (WT)

to that on CD70 knockout Jurkat cells transduced with CD70 CAR (KO). A higher activation ratio indicates target-dependent activation. Protein binding was determined by binding to recombinant biotinylated hCD70 protein and detected using streptavidin conjugated to phycoerythrin (PE) dye via flow cytometry. Protein binding values indicate the percentage of CD3+ CAR T cells that bind to human CD70 protein.

TABLE 7

| CAR | % CD69+ in WT (%) | CD69+ in KO (%) | Activation ratio (WT/KO) | Type of activation | Protein binding (%) |
|---|---|---|---|---|---|
| P02B10 | 22.50 | 8.01 | 2.81 | Target | 77.90 |
| P07D03 | 14.40 | 4.73 | 3.04 | Target | 0.68 |
| P08A02 | 67.60 | 4.69 | 14.41 | Target | 20.70 |
| P08E02 | 43.70 | 13.30 | 3.29 | Target | 57.10 |
| P08F08 | 34.90 | 10.20 | 3.42 | Target | 35.90 |
| P08G02 | 54.70 | 25.90 | 2.11 | Auto | 77.80 |
| P12B09 | 52.10 | 12.00 | 4.34 | Target | 5.74 |
| P12F02 | 34.80 | 2.91 | 11.96 | Target | 2.39 |
| P12G07 | 64.90 | 5.60 | 11.59 | Target | 15.50 |
| P13F04 | 43.20 | 10.00 | 4.32 | Target | 37.50 |
| P15D02 | 33.60 | 12.90 | 2.60 | Target | 62.00 |
| P16C05 | 59.80 | 26.50 | 2.26 | Auto | 70.80 |

Table 7: Activation ratio and protein binding of phage CARs were determined in the Jurkat screen. Activation ratio was used for in vitro characterization of CARs. Activation ratio was determined by calculating the ratio of the percentage of CD69 expression on WT Jurkat cells transduced with CD70 CAR (WT) to that on CD70 knockout Jurkat cells transduced with CD70 CAR (KO). A higher activation ratio indicates target-dependent activation. Protein binding was determined by binding to recombinant biotinylated hCD70 protein and detected using streptavidin conjugated to phycoerythrin (PE) dye via flow cytometry. Protein binding values indicate the percentage of CD3+ CAR T cells that bind to human CD70 protein.

CARs that showed minimal auto-activation, i.e., minimal expression of CD69 when transduced in CD70 KO Jurkat, were considered more desirable compared to those that are highly activated even in the absence of target since this could lead to a more exhausted CAR phenotype. Similarly, CARs with higher human CD70 protein binding were considered to be more desirable as this indicated proper expression and folding of the CARs on the surface.

Example 3: Primary T Cell Screen for In Vitro Characterization of Phage and Hybridoma CARs Primary human T cells were transduced with CD70 CARs to determine transduction efficiencies, CD70-expression on T cells in culture, and T cell subsets. Transduced CAR T cells were then frozen for use in functional assays.

Transduction efficiency of CAR constructs can vary greatly between different clones. Greater transduction efficiency leads to increased CAR T cells numbers and a more efficient production process, while CARs with low transduction efficiency may not be suitable for large scale production. High transduction efficiency is, in some embodiments, advantageous.

T cells have a range of phenotypes or subsets, indicative of differentiation state and antigen exposure. Cell surface marks help identify T cell subsets and the marker, CD62L is generally found on naïve, stem-cell memory, and central memory T cells. These cells are less differentiated relative to other subsets such as effector memory and effector T cells, and thus CAR T cells with higher percentages of CD62L positive cells are, in some embodiments, advantageous.

CD70 surface expression also varies between different tranduced CARs with some CAR T cells expressing 20-40% CD70 due to activation and transduction of T cells and others expressing none.

Materials and Methods:
Primary T Cell Isolation
T cells were purified from buffy coat samples obtained from Stanford University using Ficoll gradient density medium (Ficoll Paque PLUS/GE Healthcare Life Sciences). The PBMC layer was recovered and T cells were purified using a commercially available T cell isolation kit (Miltenyi Biotec).

T Cell Transduction with CD70 CARs
HEK293T cells were plated at 0.5 million cells per mL in 2 mL of DMEM (Gibco) supplemented with 10% FBS (Hyclone or JR Scientific) per well of a 6-well plate on Day 0. On Day 1, the lentivirus was prepared by mixing together lentiviral packaging vectors 1.5 ug psPAX2, 0.5 ug pMD2G, and 2 ug of the appropriate transfer CAR vector containing GFP tag in 250 uL Opti-MEM (Gibco) per well of the 6-well plate ("DNA mix"). 10 uL Lipofectamine 2000 (Invitrogen) in 250 uL Opti-MEM was incubated at room temperature for 5 minutes and then added to the DNA mix. The virus was incubated at room temperature for 20 minutes and the total volume of 500 uL was slowly added to the sides of the wells containing HEK293T. Purified T cells were activated in X-Vivo-15 medium (Lonza) supplemented with 100 IU/mL human IL-2 (Miltenyi Biotec), 10% FBS (Hyclone or JR Scientific), and human T activation CD2/CD3/CD28 beads at a bead:cell ratio 1:2 (Miltenyi Biotec). On Day 2, the media from each well of the 6-well plate was replaced with 2 mL per well of T cell transduction media, i.e., X-Vivo-15 supplemented with 10% FBS. On Day 3, T cells were resuspended at 0.5 million cells per mL in 2 mL of T cell transduction media per well of a 6-well plate. The lentiviral supernatants from HEK293T cells were harvested and passed through a 0.45 micron filter (EMD Millipore) to remove cell debris, and then added to the T cells along with 100 IU/mL human IL-2. On Day 6, transduction efficiency was determined by detecting GFP signal via flow cytometry. Cells were expanded into larger flasks or G-Rex vessels (Wilson Wolf) as needed using T cell expansion media, i.e., X-Vivo-15 supplemented with 5% human AB serum (Gemini Bio).

CD70 Expression and T Cell Subsets of CART Cells
On Day 13 post-activation, transduced CAR T cells were stained with anti-human CD70 antibody conjugated to PE and anti-human CD62L antibody conjugated to BV605, and acquired on a flow cytometer to obtain percentage of CD70+ and CD62L+ populations for each CAR. Expanded CAR T cells were then frozen in FBS containing 10% DMSO (Sigma Aldrich) for future use in functional assays.

TABLE 8

| CAR | CAR+ (%) | CD70+ (%) | CD62L+ (%) |
|---|---|---|---|
| 31H1 | 58.7 | 16.0 | 53.4 |
| 63B2 | 4.1 | 30.0 | 76.3 |
| 40E3 | 60.0 | 31.3 | 54.5 |
| 42C3 | 51.5 | 35.9 | 58.9 |
| 45F11 | 26.8 | 33.6 | 78.8 |
| 64F9 | 57.3 | 27.3 | 79.1 |
| 72C2 | 32.2 | 32.2 | 83.2 |
| 2F10 | 1.1 | 27.9 | 32.3 |

TABLE 8-continued

| CAR | CAR+ (%) | CD70+ (%) | CD62L+ (%) |
|---|---|---|---|
| 4F11 | 89.3 | 0.1 | 78.0 |
| 10H10 | 37.4 | 1.7 | 49.0 |
| 17G6 | 71.7 | 0.2 | 69.0 |
| 65E11 | 56.9 | 5.0 | 76.1 |
| P02B10 | 74.2 | 43.9 | 73.5 |
| P07D03 | 81.0 | 17.7 | 76.1 |
| P08A02 | 22.3 | 0.81 | 27.6 |
| P08E02 | 48.1 | 1.25 | 35.6 |
| P08F08 | 89.2 | 17.0 | 78.6 |
| P08G02 | 66.9 | 1.22 | 58.8 |
| P12B09 | 49.7 | 3.19 | 25.7 |
| P12F02 | 59.8 | 12.8 | 27.1 |
| P12G07 | 26.2 | 3.90 | 23.1 |
| P13F04 | 6.47 | 6.78 | 32.9 |
| P15D02 | 78.8 | 0.37 | 26.0 |
| P16C05 | 60.3 | 11.8 | 34.4 |

Table 8: CAR T cell phenotype at day 13 post-activation was used for in vitro characterization of phage and hybridoma CARs. CAR+ population was determined by gating on CD3+ cells; CD70-expressing population was determined by gating on live CD3+ cells; CD62L-expressing population was determined by gating on live CD3+ CAR+ CD8+ cells.

CAR constructs tested showed varying levels of transduction efficiency. Clones that resulted in low transduction efficiencies were considered less desirable since they would be less suitable for large scale production. The CAR T cell products also showed different phenotype (as measured by CD62L expression) and varying levels of CD70 expression on the surface. In general, CAR T cells that expressed higher levels of CD62L were considered more desirable since these are likely less differentiated.

Example 4: Stress Test with Phage CARs

CAR T cells were generated and frozen from 12 different scFvs from the phage library as described in the previous example. These CAR T cells were then thawed and mixed with Raji target cells that are known to express CD70 at an effector:target (E:T) ratio of 1:1 in RPMI supplemented with 10% FBS. Raji cells were added to the CAR T cells every 2 days thereafter in order to maintain an E:T ratio of 1:1. Percentage lysis of target cells and fold expansion of effector CAR T cells were determined at each time-point.

Stress test is a screening assay that involves repeated exposure of CAR T cells to their target causing the CARs to undergo proliferation and in certain cases, differentiation and exhaustion. The stress test was used to select optimal clones with high target cell lysis and proliferative abilities after several rounds of exposure to target cells.

Materials and Methods:
On Day 0, CAR T cells derived from 12 different scFvs from the phage library were thawed and mixed with Raji cells at and E:T ratio of 1:1. On Day 2, 200 uL of cells from the assay were mixed with 50 uL of cell counting beads (CountBright, Invitrogen) and acquired on the flow cytometer. The counting beads were used to determine the total number of GFP+ CAR T cells (gated on CD3+) and Raji cells (gated on CD3−) for each CAR treatment. Based on the total CAR T cell count, the number of Raji cells required to maintain E:T ratio of 1:1 was calculated and added to the respective well of the assay. This process was repeated on Day 5 and Day 7. Percentage lysis of target cells was calculated at each time-point by calculating the percentage of live Raji cells for each CAR treatment and then normalizing to non-transduced control. Fold expansion of CAR T cells over the number of CAR T cells plated on Day 0 was calculated at each time-point.

Optimal clones were those with highest target cell lysis and best fold expansion at the end of the assay on Day 7, for example P08F08.

TABLE 9

| | Serial Killing Assay | | | | | |
|---|---|---|---|---|---|---|
| | Target cell lysis (%) | | | CAR T cell fold expansion | | |
| CAR | Day 2 | Day 5 | Day 7 | Day 2 | Day 5 | Day 7 |
| P02B10 | 61.6 | −42.9 | −12.0 | 1.56 | 0.97 | 0.49 |
| P07D03 | 80.2 | 48.9 | 26.9 | 1.63 | 6.11 | 10.33 |
| P08A02 | 91.8 | 12.5 | 6.9 | 0.69 | 1.69 | 2.65 |
| P08E02 | 98.8 | 37.6 | −5.7 | 0.50 | 0.45 | 1.06 |
| P08F08 | 75.9 | 30.2 | 57.8 | 1.52 | 11.47 | 24.35 |
| P08G02 | 98.9 | 49.9 | 27.4 | 0.75 | 0.56 | 3.05 |
| P12B09 | 85.4 | 11.3 | 5.4 | 0.76 | 2.53 | 3.34 |
| P12F02 | 82.8 | −53.7 | −46.3 | 2.18 | 0.96 | 0.26 |
| P12G07 | 94.8 | 36.4 | 9.1 | 0.87 | 1.13 | 1.58 |
| P13F04 | 89.3 | 44.8 | 41.3 | 2.15 | 3.61 | 5.67 |
| P15D02 | 98.7 | 54.6 | 28.6 | 1.12 | 1.29 | 3.78 |
| P16C05 | 92.7 | 18.9 | −10.7 | 1.31 | 3.13 | 3.72 |

Table 9: Target cell lysis and CAR T cell fold expansion in a stress test were used for in vitro characterization of phage CARs. CAR T cell phenotype was determined at day 13 post-activation and the cells were then frozen on day 14. Stress test was performed using thawed CAR T cells with target Raji cells at an E:T ratio of 1:1. Target cells lysis was determined via flow cytometry by gating on CD3− target cells 2, 5, and 7 days after co-culturing with CAR T cells. CAR T cell fold expansion was determined using cell counting beads and calculating the number of cells on days 2, 5, and 7 relative to the number of cells added at the beginning of the assay. CARs highlighted in bold show high target cells lysis and fold expansion.

Example 5: Repeat of Stress Test with Optimal CARs Generated from a Second Donor CAR T cells were generated and frozen from 4 scFvs (P07D03, P08F08, P08G02, P15D02) from the phage library and 2 scFvs from the hybridoma library (4F11, 17G6) as described in Example 3. These CAR T cells were then thawed and mixed with Raji target cells that are known to express CD70 at an effector:target (E:T) ratio of 1:1 in RPMI supplemented with 10% FBS. Raji cells were added to the CAR T cells every 2 days thereafter in order to maintain an E:T ratio of 1:1. Percentage lysis of target cells and fold expansion of effector CAR T cells were determined at each time-point.

All clones performed well in terms of target cell lysis. Standout performers based on fold expansion were P08F08 and 4F11.

TABLE 10

| | CAR+ | CD70+ | CD62L+ | Serial Killing Assay | | | | | |
| | | | | Target cell lysis (%) | | | CAR T cell fold expansion | | |
| CAR | (%) | (%) | (%) | Day 2 | Day 5 | Day 7 | Day 2 | Day 5 | Day 7 |
|---|---|---|---|---|---|---|---|---|---|
| P07D03 | 48.8 | 3.2 | 63.4 | 95.1 | 98.1 | 98.7 | 1.2 | 8.1 | 11.8 |
| P08F08 | 66.9 | 2.8 | 58.3 | 96.2 | 97.8 | 98.0 | 1.4 | 12.3 | 15.8 |
| P08G02 | 37.9 | 0.1 | 35.0 | 98.6 | 97.2 | 99.5 | 0.9 | 2.4 | 5.7 |
| P15D02 | 88.4 | 0.2 | 28.4 | 98.8 | 97.7 | 98.8 | 0.8 | 4.1 | 12.2 |
| 4F11 | 88.3 | 0.3 | 54.4 | 98.3 | 96.9 | 97.3 | 0.9 | 6.0 | 15.5 |
| 17G6 | 34.8 | 0.2 | 28.3 | 98.7 | 94.3 | 90.0 | 0.5 | 0.8 | 2.4 |

Table 10: Target cell lysis and CAR T cell fold expansion in a stress test were used for in vitro characterization of optimal CARs. CAR T cell phenotype was determined at day 14 post-activation and the cells were then frozen on the same day. Stress test was performed using thawed CAR T cells with target Raji cells at an E:T ratio of 1:1. Target cells lysis was determined via flow cytometry by gating on CD3– target cells 2, 5, and 7 days after co-culturing with CAR T cells. CAR T cell fold expansion was determined using cell counting beads and calculating the number of cells on days 2, 5, and 7 relative to the number of cells added at the beginning of the assay. CARs highlighted in bold show high target cells lysis and fold expansion.

Example 6: Dose-Dependent CAR T In Vivo Efficacy in an RCC S.C. Tumor Model

CAR T cells were generated from 4F11 scFv as described in Example 3. NOD scid gamma (NSG) mice were implanted with 786-O tumors subcutaneously and once the tumors attained a volume of 200 mm$^3$, the mice were treated with 4F11 CAR T cells at different doses intravenously via tail vein injection to determine the optimal CAR T dose. 786-O cells are available from ATCC® as CRL-1932™. The 4F11 CAR T was highly efficacious in vivo and caused complete tumor regression at the 5×10$^6$ CAR T dose.

Materials and Methods:

Fifty NOD scid gamma (NSG) mice were shaved and prepared for subcutaneous tumor implant on the right flank. 786-O tumor cells that are known to express CD70 were expanded in RPMI supplemented with 10% FBS. On Day 0, 786-O cells were resuspended in serum-free RPMI at the required concentration to inject 5 million cells per animal. Tumor cells were injected in 100 uL of serum-free RPMI combined with 100 uL Matrigel (Corning) per animal subcutaneously. Day 0 baseline body weights were recorded for all animals immediately after tumor implant. Tumors were measured twice a week starting on Day 9 using Digimatic Calipers (Mitutoyo) and body weights recorded. On Day 14, when the tumors attained 200 mm$^3$ (standard error 8.39) 40 tumor-bearing mice were randomized to 4 groups of 10 mice each. 4F11 CAR T cells were thawed in RPMI supplemented with 10% FBS and resuspended in serum-free RPMI at the required concentration to inject 1, 3, or 5 million CAR+ T cells per animal (calculated based on 4F11 transduction efficiency 57.2%). Number of non-transduced T cells (NTD) required to maintain equal number of total T cells in each group were calculated and added to respective samples. CAR T cells or non-transduced T cell control were injected in 200 uL of serum-free RPMI per animal intravenously via tail vein. Tumors were measured and body weights recorded twice a week till Day 43 when the NTD group reached the study end-point (1500 mm$^3$ tumor volume).

Figure 2:
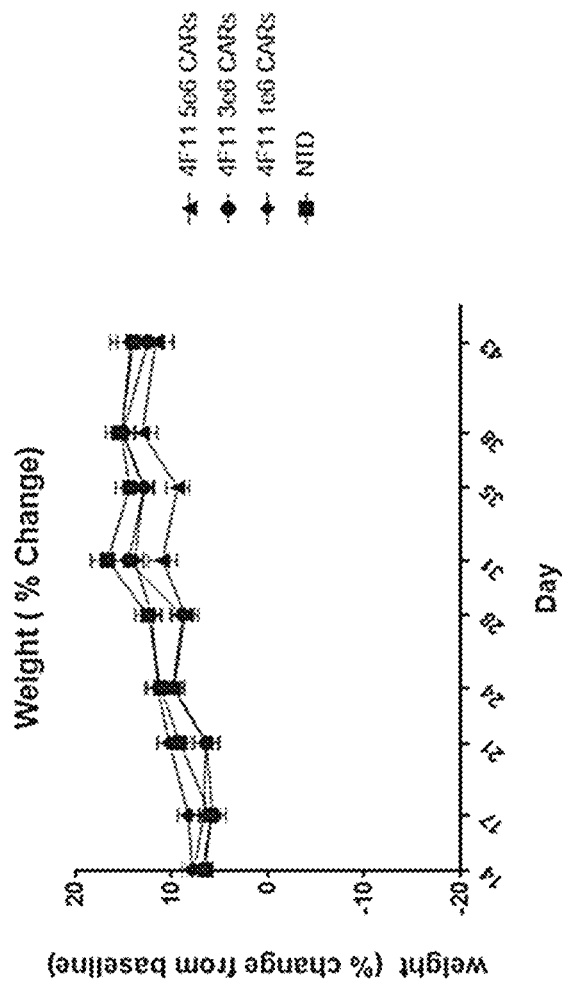
FIG. 2 is a plot showing body weights of mice treated with different doses of 4F11 CAR T-cells in a subcutaneous xenograft model.

Tumor volumes (mean and error SEM) were plotted on GraphPad Prism and statistics were calculated using one-way ANOVA with repeated measures (see FIGS. 1 and 2). While tumors were completely eliminated with the 5 million CAR+ dose, the 1 million CAR+ dose showed no efficacy as compared with the NTD group. Thus, the 3 million CAR+ dose was chosen as the optimal dose for future in vivo studies.

Example 7: In Vivo Comparison of CD70 CARs with or without CD70 TALEN Knockout in 786-O Cells 4F11 and P08F08 CAR T cells were generated as described in Example 1 with or without CD70 TALEN DNA electroporation on Day 6 post-activation. NSG mice were implanted with 786-O tumors subcutaneously and once the tumors attained a volume of 200 mm$^3$, the mice were treated with CAR T cells intravenously via tail vein injection to determine the CAR and condition with most optimal efficacy. P08F08 CAR T cells were highly efficacious in vivo and caused complete tumor regression at the 3×10$^6$ CART dose regardless of CD70 knockout (KO). 4F11 CART cells showed good efficacy when CD70 was knocked out but merely controlled tumor growth in the absence of CD70 knockout. These results suggest that CD70 knock out can improve the activity CD70 CARs.

Materials and Methods:

Seventy-five NSG mice were shaved and prepared for subcutaneous tumor implant on the right flank. 786-O tumor cells that are known to express CD70 were expanded in RPMI supplemented with 10% FBS. On Day 0, 786-O cells were resuspended in serum-free RPMI at the required concentration to inject 5 million cells per animal. Tumor cells were injected in 100 uL of serum-free RPMI combined with 100 uL Matrigel (Corning) per animal subcutaneously. Day 0 baseline body weights were recorded for all animals immediately after tumor implant. Tumors were measured twice a week starting on Day 7 using Digimatic Calipers (Mitutoyo) and body weights recorded. On Day 20, when the tumors attained 200 mm$^3$ (standard error 9.69), 60 tumor-bearing mice were randomized to 6 groups of 10 mice each. On Day 21, CAR T cells were thawed in RPMI supplemented with 10% FBS and resuspended in serum-free RPMI at 3 million CAR+ T cells per animal (calculated based on individual transduction efficiencies). Number of NTD cells required to maintain equal percentage of CAR+ T cells as well as equal number of total T cells in each group were calculated and added to respective samples. CAR T cells or NTD control were injected in 200 uL of serum-free RPMI per animal intravenously via tail vein. Tumors were measured and body weights recorded twice a week till Day 56 when the NTD group reached the study end-point (1500 mm³ tumor volume) (See FIGS. 3 and 4).

Tumor volumes (mean and error SEM) were plotted on GraphPad Prism and statistics were calculated using one-way ANOVA with repeated measures. P08F08 CAR T groups, both with or without CD70 knockout, caused complete tumor regression at the 3 million CAR+ dose. 4F11 CAR T group with CD70 knockout also caused complete rumor regression at the 3 million CAR+ dose. However, 4F11 CAR T group without CD70 knockout did not cause complete regression.

Figure 3:
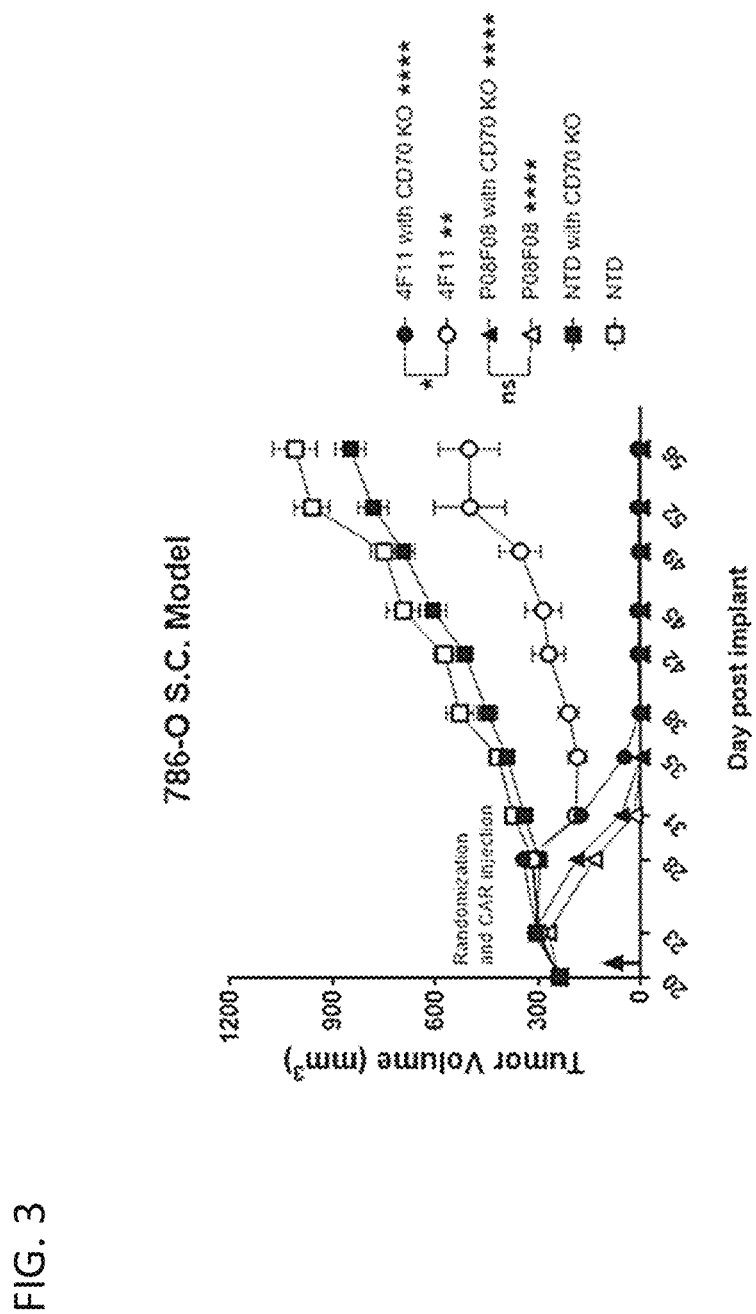
FIG. 3 is a plot showing tumor volumes of mice treated with 4F11 and P08F08 CAR T with or without CD70 KO in a subcutaneous xenograft model.
Figure 4:
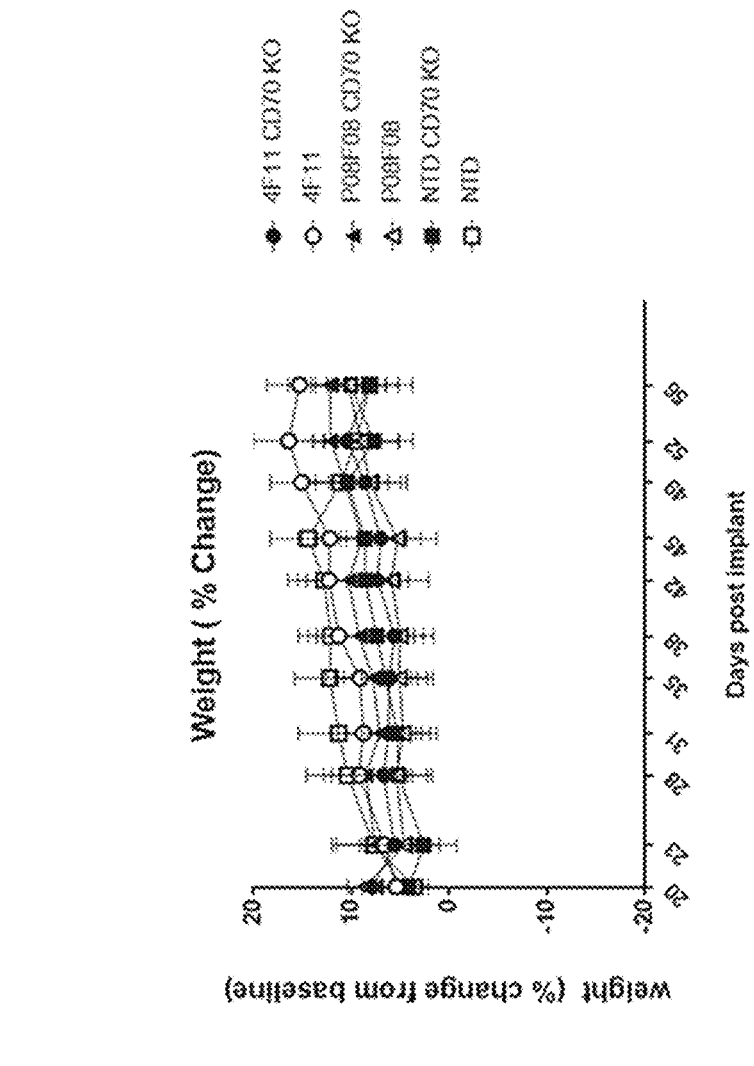
FIG. 4 is a plot showing body weights of mice treated with 4F11 and P08F08 CAR T with or without CD70 KO in a subcutaneous xenograft model.

In FIGS. 3 and 4, statistical significance over corresponding NTD control are indicated to the right of the legend (for example, P08F08 with CD70 KO over NTD with CD70 KO) Statistical significance of each CAR group with CD70 KO over corresponding CAR group without CD70 KO are indicated to the left of the legend. Statistics represent RM one-way ANOVA with Dunnett's post-hoc test (ns $p>0.05$, *$p<0.05$, $p<0.01$, *$p<0.001$, ****$p<0.0001$).

Example 8: In Vivo Comparison of CD70 CARs with or without CD70 TALEN Knockout in ACHN Metastasis Model 4F11 and P08F08 CART cells from Example 7 were further tested in ACHN cells, a renal cell cancer (RCC)-derived cell line. ACHN cells are described in Simmons et al. Animal Models of Bone Metastasis. *Veterinary Pathology* 52:827-841, 834 (2015). NSG mice were each implanted with 1 million ACHN tumor cells intravenously and 15 days post-tumor cell injection, the mice were treated with CAR T cells intravenously via tail vein injection to determine the CAR and condition with most optimal efficacy. 4F11 CAR T cells dosed at 3 million CAR+ cells per mouse were efficacious across all 3 donors tested regardless of CD70 knockout (KO). P08F08 CAR T cells showed little to no efficacy and were only tested in the absence of CD70 knockout.

Figure 5A:
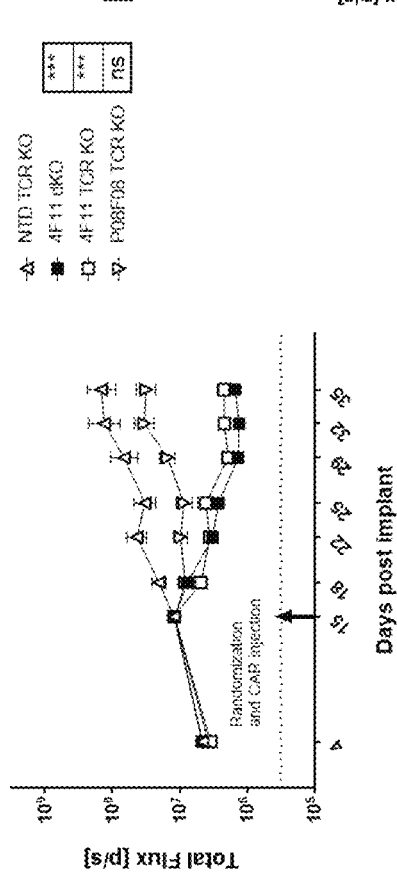
FIGS. 5A-5C is a series of plots showing tumor flux values of mice treated with control cells, cells expressing the CAR 4F11 with or without CD70 KO and with or without TCRa KO, and mice treated with cells expressing the CAR P08F08 with or without CD70 KO and with or without TCRa KO, across 3 donors in the ACHN lung metastasis model.
Figure 5C:
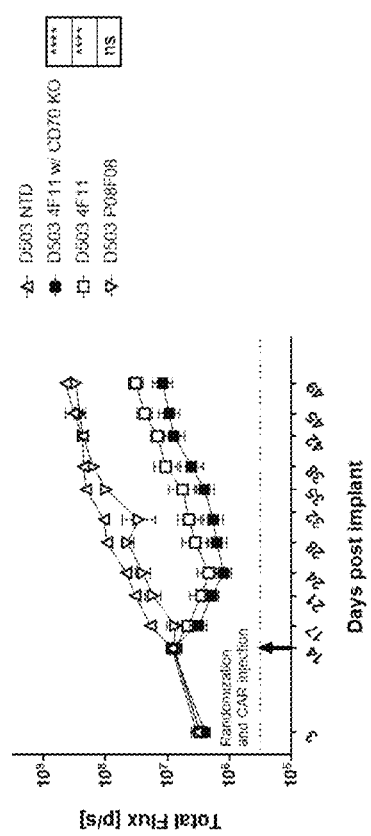
Figure 5B:
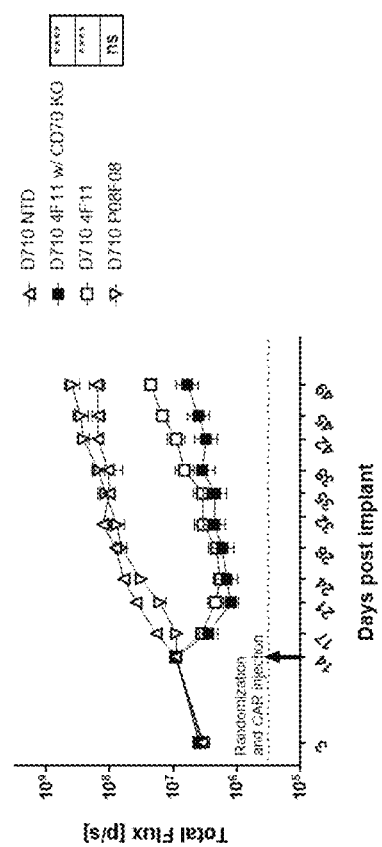
Figure 6A:
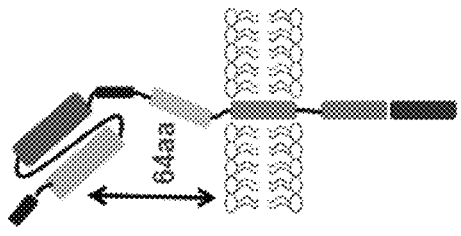
FIGS. 6A-6F show five exemplary, non-limiting CAR designs. In each of FIGS. 6A-6F an approximate distance of the antigen-binding fragment of the CD70-specific domain to the cell membrane is indicated by a double arrow, labeled with the number of amino-acid residues (aa) between the scFv and the transmembrane domain.
Figure 6B:
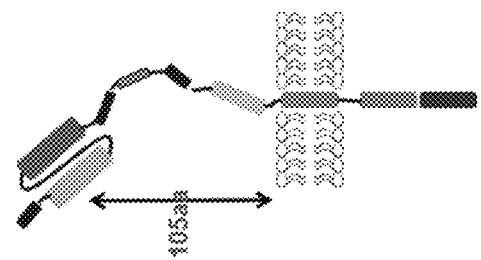
Figure 6C:
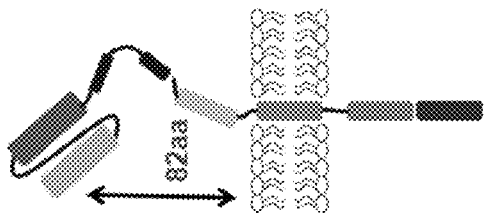
Figure 6D:
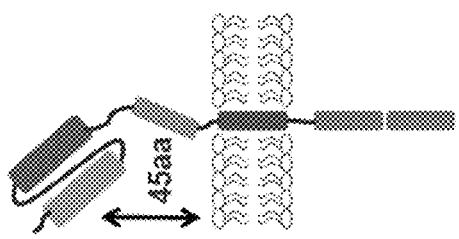
Figure 6E:
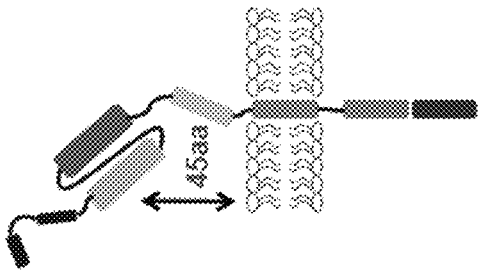
Figure 6F:
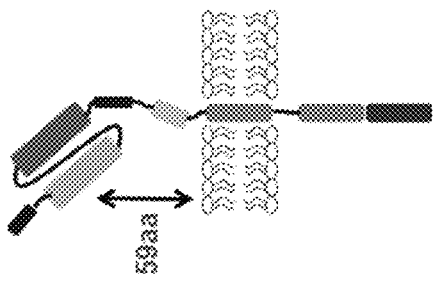

Materials and Methods:

Forty-five NSG mice were prepared for intravenous tumor injection via tail vein. ACHN tumor cells that are known to express CD70 were expanded in MEM supplemented with 10% FBS. On Day 0, ACHN tumor cells were resuspended in serum-free MEM at the required concentration to inject 1 million cells per animal. ACHN tumor cells were injected in 200 uL of serum-free MEM intravenously. Day 4 baseline body weights were recorded for all animals. Tumor flux was measured twice a week starting on Day 7 using bioluminence (IVIS Spectrum Imager™ from PerkinElmer™; auto-exposure with a maximum exposure time of 120 seconds), and body weights were recorded. On Day 20, when the tumors attained 200 mm³ (standard error 9.69), 20 tumor-bearing mice were randomized to 4 groups of 5 mice each. On Day 15, CAR T cells were thawed in MEM supplemented with 10% FBS and resuspended in serum-free MEM at 3 million CAR+ T cells per animal (calculated based on individual transduction efficiencies). Number of NTD cells required to maintain equal percentage of CAR+ T cells as well as equal number of total T cells in each group were calculated and added to respective samples. CAR T cells or NTD control were injected in 200 uL of serum-free MEM per animal intravenously via tail vein. Tumor flux was measured and body weights recorded twice a week till Day 35-49 when the NTD group reached the study end-point (~20% body weight loss) (See FIGS. 5a, 5b and 5c).

Bioluminescence (mean and error SEM) were plotted on GraphPad Prism and statistics were calculated using one-way ANOVA with repeated measures. 4F11 CAR T groups, both with or without CD70 knockout, showed anti-tumor efficacy at the 3 million CAR+ dose. P08F08 CAR T group without CD70 knockout showed little to no efficacy at the 3 million CAR+ dose.

Example 9: Activity of CD70-Specific CART Cells Expressing CD20 Epitopes

Part A: In Vitro Activity

CD70-specific CAR T cells expressing CD20 epitopes are effective against 786-O target cells in cell-killing assay Six CD70-specific CAR formats were designed (FIG. 6A-6F). Sequences of the constructed CARs are as shown in Tables 11A-11F:

TABLE 11A

| Format | Clone Name | Full Amino Sequence | Seq ID NO: |
|---|---|---|---|
| No Epitope (FIG. 6A) | 4F11 | MALPVTALLLPLALLLHAARPQVTLKESGPVLVKPTETLTLTCT VSGFSLSNARMGVTWIRQPPGKALEWLAHIFSNDEKSYSTSLKS RLTISKDTSKTQVVLTMTNMDPVDTATYYCARIRDYYDISSYYD YWGQGTLVSVSSGGGGSGGGGSGGGGSDIQMTQSPSAMSASV GDRVTITCRASQDISNYLAWFQQKPGKVPKRLIYAASSLQSGVP SRFSGSGSGTEFTLTISSLLPEDFATYYCLQLNSFPFTFGGGTKVE INTTTPAPRPPTPAPTIASQPLSLRPEACRPAAGGAVHTRGLDFA CDIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKGHDGLYQGLSTATKDTYDAL HMQALPPR | 619 |
| | 4F11-2 | MALPVTALLLPLALLLHAARPQVTLKESGPVLVKPTETLTLTCT VSGFSLSNARMGVTWIRQPPGKALEWLAHIFSNDEKSYSTSLKS RLTISKDTSKTQVVLTMTNMDPVDTATYYCARIRDYYDISSYYD YWGQGTLVSVSSGGGGSGGGGSGGGGSGGGGSDIQMTQSPSA MSASVGDRVTITCRASQDISNYLAWFQQKPGKVPKRLIYAASSL QSGVPSRFSGSGSGTEFTLTISSLLPEDFATYYCLQLNSFPFTFGG GTKVEINTTTPAPRPPTPAPTIASQPLSLRPEACRPAAGGAVHTR GLDFACDIYIWAPLAGTCGVLLLSLVITLYCKRGRKKLLYIFKQP FMRPVQTTQEEDGCSCRFPEEEEGGCELRVKFSRSADAPAYQQ GQNQLYNELNLGRREEYDVLDKRRGRDPEMGGKPRRKNPQEG LYNELQKDKMAEAYSEIGMKGERRRGKGHDGLYQGLSTATKD TYDALHMQALPPR | 672 |

TABLE 11A-continued

| Format | Clone Name | Full Amino Sequence | Seq ID NO: |
|---|---|---|---|
| | P08F08 | MALPVTALLLPLALLLHAARPEVQLVQSGAEVKKPGESLKISCK GSGYGFTSYWIGWVRQMPGKGLEWMGIIHPDDSDTKYSPSFQG QVTISADKSISTAYLQWSSLKASDTAMYYCASSYLRGLWGGYF DYWGQGTLVTVSSGGGGSGGGGSGGGGSGGGGSELQSVLTQP PSASGTPGQRVTISCSGSSSNIGSNYVNWYQQLPGTAPKLLIYGD YQRPSGVPDRFSGSKSGTSASLAISGLRSEDEADYYCATRDDSLS GSVVFGTGTKLTVLTTTPAPRPPTPAPTIASQPLSLRPEACRPAA GGAVHTRGLDFACDIYIWAPLAGTCGVLLLSLVITLYCKRGRKK LLYIFKQPFMRPVQTTQEEDGCSCRFPEEEEGGCELRVKFSRSAD APAYQQGQNQLYNELNLGRREEYDVLDKRRGRDPEMGGKPRR KNPQEGLYNELQKDKMAEAYSEIGMKGERRRGKGHDGLYQGL STATKDTYDALHMQALPPR | 327 |
| | 10A1 | MALPVTALLLPLALLLHAARPQVQLQESGPGLVKPSETLSLTCT VSGGSISYYYWTWIRQPPGKGLEWIGHIYYSGSTNYNPSLKSRV TISIDTSKNLFSLKLSSVTAADTAVYYCARAEGSIDAFDFWGQGT MVTVSSGGGGSGGGGSGGGGSGGGGSDIQMTQSPSTLSASVGD RVTITCRASQSISTWLAWYQQKPGKAPKVLIYKASSLESGVPSR FSGSGSGTEFILTINSLQPDDFASYYCQQYKSYSHTFGQGTKLEI KTTTPAPRPPTPAPTIASQPLSLRPEACRPAAGGAVHTRGLDFAC DIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKGHDGLYQGLSTATKDTYDAL HMQALPPR | 580 |
| | 11C1 | MALPVTALLLPLALLLHAARPQVQLQESGPGLVKPSETLSLNCT VSGGSISYYYWTWIRQPPGKGLEWIGHVIYSGTTNYNPSLKSRV TISVDTSKNQFSLKLNSVTAADTAVYYCVRAEGSIDAFDLWGQ GTMVTVSSGGGGSGGGGSGGGGSGGGGSDIQMTQSPSILSASV GDRVTITCRASQSVSSWLAWYQQKPGKAPKVLIYKASSLESGV PSRFSGTGSGTEFTLTISSLQSDDFATYYCQQYNTYSHTFGQGTK LEIKTTTPAPRPPTPAPTIASQPLSLRPEACRPAAGGAVHTRGLDF ACDIYIWAPLAGTCGVLLLSLVITLYCKRGRKKLLYIFKQPFMRP VQTTQEEDGCSCRFPEEEEGGCELRVKFSRSADAPAYQQGQNQ LYNELNLGRREEYDVLDKRRGRDPEMGGKPRRKNPQEGLYNE LQKDKMAEAYSEIGMKGERRRGKGHDGLYQGLSTATKDTYDA LHMQALPPR | 583 |
| | 11E1 | MALPVTALLLPLALLLHAARPQVQLQESGPGLVKPLQTLSLTCT VSGGSISSdgYYWSWIRQNPGKGLEWIGYMYYSGSTYYNPSLKS RVTISVDTSKNQFSLKLRSVTAADTAVYYCTRDFGWYFDLWGR GTLVTVSSGGGGSGGGGSGGGGSGGGGSDIQMTQSPSSLSASV GDSITITCRASQDIDNYLAWYQQKTGKVPKVLIYAASALQSGVP SRFSGSGSGTDFTLTISSLQPEDVATYYCQNYNSGPRTFGQGTK VEIKTTTPAPRPPTPAPTIASQPLSLRPEACRPAAGGAVHTRGLD FACDIYIWAPLAGTCGVLLLSLVITLYCKRGRKKLLYIFKQPFMR PVQTTQEEDGCSCRFPEEEEGGCELRVKFSRSADAPAYQQGQN QLYNELNLGRREEYDVLDKRRGRDPEMGGKPRRKNPQEGLYN ELQKDKMAEAYSEIGMKGERRRGKGHDGLYQGLSTATKDTYD ALHMQALPPR | 585 |
| | 12A2 | MALPVTALLLPLALLLHAARPQVQLQESGPGLVKPSQSLSLTCS VSGGSVSSdgYYWSWIRQHPGKGLEWIGYIYYRRITDYNPSLKS RVNISLDTSKNQFSLKLSSVTAADTAVYYCARDFGWYFDLWGR GTLVAVSSGGGGSGGGGSGGGGSGGGGSDIQMTQSPSSLSASV GDRVTITCRASQDISNYLTWYQQKPGRVPEVLIYAASALQSGVP SRFSGSGSGTDFTLTISSLQPEDVATYYCQNYNSAPRTFGQGTK VEIKTTTPAPRPPTPAPTIASQPLSLRPEACRPAAGGAVHTRGLD FACDIYIWAPLAGTCGVLLLSLVITLYCKRGRKKLLYIFKQPFMR PVQTTQEEDGCSCRFPEEEEGGCELRVKFSRSADAPAYQQGQN QLYNELNLGRREEYDVLDKRRGRDPEMGGKPRRKNPQEGLYN ELQKDKMAEAYSEIGMKGERRRGKGHDGLYQGLSTATKDTYD ALHMQALPPR | 586 |
| | 12C5 | MALPVTALLLPLALLLHAARPEVELVESGGGMVQPGRSLRLSC AASGFTFSDYGMHWVRQAPGMGLEWVTVIWYDGSnKYYADS VKGRFTISRDNSKNTVFLQMNSLRAEDTAVYYCARDEVGfvGAF DIWGQGTMVTVSSGGGGSGGGGSGGGGSGGGGSDIQLTQSPSF LSASVGDRVIITCRASQGINSHLAWYQQKPGKAPKLLIYYASTLP SGVPSRFSGSGSGTEFTLTVTSLQPEDFATYYCQQLNHYPITFGQ GTRLDINTTTPAPRPPTPAPTIASQPLSLRPEACRPAAGGAVHTR GLDFACDIYIWAPLAGTCGVLLLSLVITLYCKRGRKKLLYIFKQP FMRPVQTTQEEDGCSCRFPEEEEGGCELRVKFSRSADAPAYQQ | 588 |

TABLE 11A-continued

| Format | Clone Name | Full Amino Sequence | Seq ID NO: |
|---|---|---|---|
| | | GQNQLYNELNLGRREEYDVLDKRRGRDPEMGGKPRRKNPQEG LYNELQKDKMAEAYSEIGMKGERRRGKGHDGLYQGLSTATKD TYDALHMQALPPR | |
| | 12C6 | MALPVTALLLPLALLLHAARPEVELVESGGGMVQPGRSLRLSC AASGFTFSDYGMHWVRQAPGMGLEWVTVIWYDGSnKYYADS VKGRFTISRDNSKNTVFLQMNSLRAEDTAVYYCARDEVGfvGAF DIWGQGTMVTVSSGGGGSGGGGSGGGGSGGGGSDIQLTQSPSF LSASVGDRVIITCRASQGINSHLAWYQQKPGKAPKLLIYYASTLP SGVPSRFSGSGSGTEFTLTVTSLQPEDFATYYCQQLNHYPITFGQ GTRLEIKTTTPAPRPPTPAPTIASQPLSLRPEACRPAAGGAVHTR GLDFACDIYIWAPLAGTCGVLLLSLVITLYCKRGRKKLLYIFKQP FMRPVQTTQEEDGCSCRFPEEEEGGCELRVKFSRSADAPAYQQ GQNQLYNELNLGRREEYDVLDKRRGRDPEMGGKPRRKNPQEG LYNELQKDKMAEAYSEIGMKGERRRGKGHDGLYQGLSTATKD TYDALHMQALPPR | 673 |
| | 8F8 | MALPVTALLLPLALLLHAARPQVQLQESGPGLVQPSETLSLTCT VSGGSISYYYWSWIRQPPGKGLEWIGNINYMGNTIYNPSLKSRV TISVDTSKDQFSLKLTSVSAADTAVYYCVRAEGSIDAFDFWGQG TLVAVSLGGGGSGGGGSGGGGSGGGGSDIQMTQSPSTLSASVG DRVTITCRASQSISSWLAWYQQKPGKAPKVLIYKASNLESGVPS RFSGSGSGTEFTLTISSLQPDDFATYYCQQYNSYSCTFGQGTKLE IKTTTPAPRPPTPAPTIASQPLSLRPEACRPAAGGAVHTRGLDFA CDIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKGHDGLYQGLSTATKDTYDAL HMQALPPR | 596 |

TABLE 11B

| Format | Clone Name | Full Amino Sequence | Seq ID NO: |
|---|---|---|---|
| SR2 (FIG. 6B) | 4F11-SR2 | MALPVTALLLPLALLLHAARPQVTLKESGPVLVKPTETLTLTCT VSGFSLSNARMGVTWIRQPPGKALEWLAHIFSNDEKSYSTSLKS RLTISKDTSKTQVVLTMTNMDPVDTATYYCARIRDYYDISSYY DYWGQGTLVSVSSGGGGSGGGGSGGGGSDIQMTQSPSAMSAS VGDRVTITCRASQDISNYLAWFQQKPGKVPKRLIYAASSLQSGV PSRFSGSGSGTEFTLTISSLLPEDFATYYCLQLNSFPFTFGGGTKV EINGSGGGGSCPYSNPSLCSGGGGSCPYSNPSLCSGGGGSTTTPA PRPPTPAPTIASQPLSLRPEACRPAAGGAVHTRGLDFACDIYIWA PLAGTCGVLLLSLVITLYCKRGRKKLLYIFKQPFMRPVQTTQEE DGCSCRFPEEEEGGCELRVKFSRSADAPAYQQGQNQLYNELNL GRREEYDVLDKRRGRDPEMGGKPRRKNPQEGLYNELQKDKM AEAYSEIGMKGERRRGKGHDGLYQGLSTATKDTYDALHMQAL PPR | 620 |
| | 4F11-2-SR2 | MALPVTALLLPLALLLHAARPQVTLKESGPVLVKPTETLTLTCT VSGFSLSNARMGVTWIRQPPGKALEWLAHIFSNDEKSYSTSLKS RLTISKDTSKTQVVLTMTNMDPVDTATYYCARIRDYYDISSYY DYWGQGTLVSVSSGGGGSGGGGSGGGGSGGGGSDIQMTQSPS AMSASVGDRVTITCRASQDISNYLAWFQQKPGKVPKRLIYAASS LQSGVPSRFSGSGSGTEFTLTISSLLPEDFATYYCLQLNSFPFTFG GGTKVEINGSGGGGSCPYSNPSLCSGGGGSCPYSNPSLCSGGGG STTTPAPRPPTPAPTIASQPLSLRPEACRPAAGGAVHTRGLDFAC DIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKGHDGLYQGLSTATKDTYDAL HMQALPPR | 674 |
| | P08F08-SR2 | MALPVTALLLPLALLLHAARPEVQLVQSGAEVKKPGESLKISCK GSGYGFTSYWIGWVRQMPGKGLEWMGIIHPDDSDTKYSPSFQG QVTISADKSISTAYLQWSSLKASDTAMYYCASSYLRGLWGGYF DYWGQGTLVTVSSGGGGSGGGGSGGGGSGGGGSELQSVLTQP PSASGTPGQRVTISCSGSSSNIGSNYVNWYQQLPGTAPKLLIYGD YQRPSGVPDRFSGSKSGTSASLAISGLRSEDEADYYCATRDDSL SGSVVFGTGTKLTVLGGGGGSCPYSNPSLCSGGGGSCPYSNPS LCSGGGGSTTTPAPRPPTPAPTIASQPLSLRPEACRPAAGGAVHT RGLDFACDIYIWAPLAGTCGVLLLSLVITLYCKRGRKKLLYIFK QPFMRPVQTTQEEDGCSCRFPEEEEGGCELRVKFSRSADAPAYQ QGQNQLYNELNLGRREEYDVLDKRRGRDPEMGGKPRRKNPQE | 621 |

TABLE 11B-continued

| Format | Clone Name | Full Amino Sequence | Seq ID NO: |
|---|---|---|---|
| | | GLYNELQKDKMAEAYSEIGMKGERRRGKHDGLYQGLSTATK DTYDALHMQALPPR | |
| | 10A1-SR2 | MALPVTALLLPLALLLHAARPQVQLQESGPGLVKPSETLSLTCT VSGGSISYYYWTWIRQPPGKGLEWIGHIYYSGSTNYNPSLKSRV TISIDTSKNLFSLKLSSVTAADTAVYYCARAEGSIDAFDFWGQG TMVTVSSGGGGSGGGGSGGGGSGGGGSDIQMTQSPSTLSASVG DRVTITCRASQSISTWLAWYQQKPGKAPKVLIYKASSLESGVPS RFSGSGSGTEFILTINSLQPDDFASYYCQQYKSYSHTFGQGTKLE IKGSGGGGSCPYSNPSLCSGGGGSCPYSNPSLCSGGGGSTTTPAP RPPTPAPTIASQPLSLRPEACRPAAGGAVHTRGLDFACDIYIWAP LAGTCGVLLLSLVITLYCKRGRKKLLYIFKQPFMRPVQTTQEED GCSCRFPEEEEGGCELRVKFSRSADAPAYQQGQNQLYNELNLG RREEYDVLDKRRGRDPEMGGKPRRKNPQEGLYNELQKDKMAE AYSEIGMKGERRRGKHDGLYQGLSTATKDTYDALHMQALPPR | 622 |
| | 11C1-SR2 | MALPVTALLLPLALLLHAARPQVQLQESGPGLVKPSETLSLNCT VSGGSISYYYWTWIRQPPGKGLEWIGHVIYSGTTNYNPSLKSRV TISVDTSKNQFSLKLNSVTAADTAVYYCVRAEGSIDAFDLWGQ GTMVTVSSGGGGSGGGGSGGGGSGGGGSDIQMTQSPSILSASV GDRVTITCRASQSVSSWLAWYQQKPGKAPKVLIYKASSLESGV PSRFSGTGSGTEFTLTISSLQSDDFATYYCQQYNTYSHTFGQGTK LEIKGSGGGGSCPYSNPSLCSGGGGSCPYSNPSLCSGGGGSTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRRGKHDGLYQGLSTATKDTYDALHMQAL PPR | 623 |
| | 11E1-SR2 | MALPVTALLLPLALLLHAARPQVQLQESGPGLVKPLQTLSLTCT VSGGSISSdgYYWSWIRQNPGKGLEWIGYMYYSGSTYYNPSLKS RVTISVDTSKNQFSLKLRSVTAADTAVYYCTRDFGWYFDLWGR GTLVTVSSGGGGSGGGGSGGGGSGGGGSDIQMTQSPSSLSASV GDSITITCRASQDIDNYLAWYQQKTGKVPKVLIYAASALQSGVP SRFSGSGSGTDFTLTISSLQPEDVATYYCQNYNSGPRTFGQGTK VEIKGSGGGGSCPYSNPSLCSGGGGSCPYSNPSLCSGGGGSTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRRGKHDGLYQGLSTATKDTYDALHMQAL PPR | 624 |
| | 12A2-SR2 | MALPVTALLLPLALLLHAARPQVQLQESGPGLVKPSQSLSLTCS VSGGSVSSdgYYWSWIRQHPGKGLEWIGYIYYRRITDYNPSLKS RVNISLDTSKNQFSLKLSSVTAADTAVYYCARDFGWYFDLWGR GTLVAVSSGGGGSGGGGSGGGGSGGGGSDIQMTQSPSSLSASV GDRVTITCRASQDISNYLTWYQQKPGRVPEVLIYAASALQSGVP SRFSGSGSGTDFTLTISSLQPEDVATYYCQNYNSAPRTFGQGTK VEIKGSGGGGSCPYSNPSLCSGGGGSCPYSNPSLCSGGGGSTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRRGKHDGLYQGLSTATKDTYDALHMQAL PPR | 625 |
| | 12C5-SR2 | MALPVTALLLPLALLLHAARPEVELVESGGGMVQPGRSLRLSC AASGFTFSDYGMHWVRQAPGMGLEWVTVIWYDGSnKYYADS VKGRFTISRDNSKNTVFLQMNSLRAEDTAVYYCARDEVGfvGA FDIWGQGTMVTVSSGGGGSGGGGSGGGGSGGGGSDIQLTQSPS FLSASVGDRVIITCRASQGINSHLAWYQQKPGKAPKLLIYYAST LPSGVPSRFSGSGSGTEFTLTVTSLQPEDFATYYCQQLNHYPITF GQGTRLDINGSGGGGSCPYSNPSLCSGGGGSCPYSNPSLCSGGG GSTTTPAPRPPTPAPTIASQPLSLRPEACRPAAGGAVHTRGLDFA CDIYIWAPLAGTCGVLLLSLVITLYCKRGRKKLLYIFKQPFMRP VQTTQEEDGCSCRFPEEEEGGCELRVKFSRSADAPAYQQGQNQ LYNELNLGRREEYDVLDKRRGRDPEMGGKPRRKNPQEGLYNE LQKDKMAEAYSEIGMKGERRRGKHDGLYQGLSTATKDTYDA LHMQALPPR | 626 |
| | 12C6-SR2 | MALPVTALLLPLALLLHAARPEVELVESGGGMVQPGRSLRLSC AASGFTFSDYGMHWVRQAPGMGLEWVTVIWYDGSnKYYADS VKGRFTISRDNSKNTVFLQMNSLRAEDTAVYYCARDEVGfvGA FDIWGQGTMVTVSSGGGGSGGGGSGGGGSGGGGSDIQLTQSPS FLSASVGDRVIITCRASQGINSHLAWYQQKPGKAPKLLIYYAST | 675 |

TABLE 11B-continued

| Format | Clone Name | Full Amino Sequence | Seq ID NO: |
|---|---|---|---|
| | | LPSGVPSRFSGSGSGTEFTLTVTSLQPEDFATYYCQQLNHYPITF GQGTRLEIKGSGGGGSCPYSNPSLCSGGGGSCPYSNPSLCSGGG GSTTTPAPRPPTPAPTIASQPLSLRPEACRPAAGGAVHTRGLDFA CDIYIWAPLAGTCGVLLLSLVITLYCKRGRKKLLYIFKQPFMRP VQTTQEEDGCSCRFPEEEEGGCELRVKFSRSADAPAYQQGQNQ LYNELNLGRREEYDVLDKRRGRDPEMGGKPRRKNPQEGLYNE LQKDKMAEAYSEIGMKGERRRGKGHDGLYQGLSTATKDTYDA LHMQALPPR | |
| | 8F8-SR2 | MALPVTALLLPLALLLHAARPQVQLQESGPGLVQPSETLSLTCT VSGGSISYYYWSWIRQPPGKGLEWIGNINYMGNTIYNPSLKSRV TISVDTSKDQFSLKLTSVSAADTAVYYCVRAEGSIDAFDFWGQG TLVAVSLGGGGSGGGGSGGGGSGGGGSDIQMTQSPSTLSASVG DRVTITCRASQSISSWLAWYQQKPGKAPKVLIYKASNLESGVPS RFSGSGSGTEFTLTISSLQPDDFATYYCQQYNSYSCTFGQGTKLE IKGSGGGGSCPYSNPSLCSGGGGSCPYSNPSLCSGGGGSTTTPAP RPPTPAPTIASQPLSLRPEACRPAAGGAVHTRGLDFACDIYIWAP LAGTCGVLLLSLVITLYCKRGRKKLLYIFKQPFMRPVQTTQEED GCSCRFPEEEEGGCELRVKFSRSADAPAYQQGQNQLYNELNLG RREEYDVLDKRRGRDPEMGGKPRRKNPQEGLYNELQKDKMAE AYSEIGMKGERRRGKGHDGLYQGLSTATKDTYDALHMQALPPR | 627 |

TABLE 11C

| Format | Clone Name | Full Amino Sequence | Seq ID NO: |
|---|---|---|---|
| RSRQR (FIG. 6C) | 4F11-RSRQR | MALPVTALLLPLALLLHAARPGGGGSCPYSNPSLCSGGGGSGG GGSQVTLKESGPVLVKPTETLTLTCTVSGFSLSNARMGVTWIRQ PPGKALEWLAHIFSNDEKSYSTSLKSRLTISKDTSKTQVVLTMT NMDPVDTATYYCARIRDYYDISSYYDYWGQGTLVSVSSGGGGS GGGGSGGGGSDIQMTQSPSAMSASVGDRVTITCRASQDISNYLA WFQQKPGKVPKRLIYAASSLQSGVPSRFSGSGSGTEFTLTISSLLP EDFATYYCLQLNSFPFTFGGGTKVEINGSGGGGSCPYSNPSLCSG GGGSELPTQGTFSNVSTNVSPAKPTTTACPYSNPSLCTTTPAPRP PTPAPTIASQPLSLRPEACRPAAGGAVHTRGLDFACDIYIWAPLA GTCGVLLLSLVITLYCKRGRKKLLYIFKQPFMRPVQTTQEEDGC SCRFPEEEEGGCELRVKFSRSADAPAYQQGQNQLYNELNLGRR EEYDVLDKRRGRDPEMGGKPRRKNPQEGLYNELQKDKMAEAY SEIGMKGERRRGKGHDGLYQGLSTATKDTYDALHMQALPPR | 628 |
| | 4F11-2-RSRQR | MALPVTALLLPLALLLHAARPGGGGSCPYSNPSLCSGGGGSGG GGSQVTLKESGPVLVKPTETLTLTCTVSGFSLSNARMGVTWIRQ PPGKALEWLAHIFSNDEKSYSTSLKSRLTISKDTSKTQVVLTMT NMDPVDTATYYCARIRDYYDISSYYDYWGQGTLVSVSSGGGGS GGGGSGGGGSDIQMTQSPSAMSASVGDRVTITCRASQD ISNYLAWFQQKPGKVPKRLIYAASSLQSGVPSRFSGSGSGTEFTL TISSLLPEDFATYYCLQLNSFPFTFGGGTKVEINGSGGGGSCPYS NPSLCSGGGGSELPTQGTFSNVSTNVSPAKPTTTACPYSNPSLCT TTPAPRPPTPAPTIASQPLSLRPEACRPAAGGAVHTRGLDFACDI YIWAPLAGTCGVLLLSLVITLYCKRGRKKLLYIFKQPFMRPVQT TQEEDGCSCRFPEEEEGGCELRVKFSRSADAPAYQQGQNQLYN ELNLGRREEYDVLDKRRGRDPEMGGKPRRKNPQEGLYNELQK DKMAEAYSEIGMKGERRRGKGHDGLYQGLSTATKDTYDALH MQALPPR | 676 |
| | P08F08-RSRQR | MALPVTALLLPLALLLHAARPGGGGSCPYSNPSLCSGGGGSGG GGSEVQLVQSGAEVKKPGESLKISCKGSGYGFTSYWIGWVRQM PGKGLEWMGIIHPDDSDTKYSPSFQGQVTISADKSISTAYLQWSS LKASDTAMYYCASSYLRGLWGGYFDYWGQGTLVTVSSGGGGS GGGGSGGGGSGGGGSELQSVLTQPPSASGTPGQRVTISCSGSSS NIGSNYVNWYQQLPGTAPKLLIYGDYQRPSGVPDRFSGSKSGTS ASLAISGLRSEDEADYYCATRDDSLSGSVVFGTGTKLTVLGSGG GGSCPYSNPSLCSGGGGSELPTQGTFSNVSTNVSPAKPTTTACPY SNPSLCTTTPAPRPPTPAPTIASQPLSLRPEACRPAAGGAVHTRG LDFACDIYIWAPLAGTCGVLLLSLVITLYCKRGRKKLLYIFKQPF MRPVQTTQEEDGCSCRFPEEEEGGCELRVKFSRSADAPAYQQG QNQLYNELNLGRREEYDVLDKRRGRDPEMGGKPRRKNPQEGL YNELQKDKMAEAYSEIGMKGERRRGKGHDGLYQGLSTATKDT YDALHMQALPPR | 629 |
| | 10A1-RSRQR | MALPVTALLLPLALLLHAARPGGGGSCPYSNPSLCSGGGGSGG GGSQVQLQESGPGLVKPSETLSLTCTVSGGSISYYYWTWIRQPP GKGLEWIGHIYYSGSTNYNPSLKSRVTISIDTSKNLFSLKLSSVTA | 630 |

TABLE 11C-continued

| Format | Clone Name | Full Amino Sequence | Seq ID NO: |
|---|---|---|---|
| | | ADTAVYYCARAEGSIDAFDFWGQGTMVTVSSGGGGSGGGGSG GGGSGGGGSDIQMTQSPSTLSASVGDRVTITCRASQSISTWLAW YQQKPGKAPKVLIYKASSLESGVPSRFSGSGSGTEFILTINSLQPD DFASYYCQQYKSYSHTFGQGTKLEIKGSGGGGSCPYSNPSLCSG GGGSELPTQGTFSNVSTNVSPAKPTTTACPYSNPSLCTTTPAPRP PTPAPTIASQPLSLRPEACRPAAGGAVHTRGLDFACDIYIWAPLA GTCGVLLLSLVITLYCKRGRKKLLYIFKQPFMRPVQTTQEEDGC SCRFPEEEEGGCELRVKFSRSADAPAYQQGQNQLYNELNLGRR EEYDVLDKRRGRDPEMGGKPRRKNPQEGLYNELQKDKMAEAY SEIGMKGERRRGKHDGLYQGLSTATKDTYDALHMQALPPR | |
| | 11C1-RSRQR | MALPVTALLLPLALLLHAARPGGGGSCPYSNPSLCSGGGGSGG GGSQVQLQESGPGLVKPSETLSLNCTVSGGSISYYYWTWIRQPP GKGLEWIGHVIYSGTTNYNPSLKSRVTISVDTSKNQFSLKLNSVT AADTAVYYCVRAEGSIDAFDLWGQGTMVTVSSGGGGSGGGGS GGGGSGGGGSDIQMTQSPSILSASVGDRVTITCRASQSVSSWLA WYQQKPGKAPKVLIYKASSLESGVPSRFSGTGSGTEFTLTISSLQ SDDFATYYCQQYNTYSHTFGQGTKLEIKGSGGGGSCPYSNPSLC SGGGGSELPTQGTFSNVSTNVSPAKPTTTACPYSNPSLCTTTPAP RPPTPAPTIASQPLSLRPEACRPAAGGAVHTRGLDFACDIYIWAP LAGTCGVLLLSLVITLYCKRGRKKLLYIFKQPFMRPVQTTQEED GCSCRFPEEEEGGCELRVKFSRSADAPAYQQGQNQLYNELNLG RREEYDVLDKRRGRDPEMGGKPRRKNPQEGLYNELQKDKMAE AYSEIGMKGERRRGKHDGLYQGLSTATKDTYDALHMQALPPR | 631 |
| | 11E1-RSRQR | MALPVTALLLPLALLLHAARPGGGGSCPYSNPSLCSGGGGSGG GGSQVQLQESGPGLVKPLQTLSLTCTVSGGSISSdgYYWSWIRQ NPGKGLEWIGMYYSGSTYYNPSLKSRVTISVDTSKNQFSLKLR SVTAADTAVYYCTRDFGWYFDLWGRGTLVTVSSGGGGSGGGG SGGGGSGGGGSDIQMTQSPSSLSASVGDSITITCRASQDIDNYLA WYQQKTGKVPKVLIYAASALQSGVPSRFSGSGSGTDFTLTISSL QPEDVATYYCQNYNSGPRTFGQGTKVEIKGSGGGGSCPYSNPSL CSGGGGSELPTQGTFSNVSTNVSPAKPTTTACPYSNPSLCTTTPA PRPPTPAPTIASQPLSLRPEACRPAAGGAVHTRGLDFACDIYIWA PLAGTCGVLLLSLVITLYCKRGRKKLLYIFKQPFMRPVQTTQEE DGCSCRFPEEEEGGCELRVKFSRSADAPAYQQGQNQLYNELNL GRREEYDVLDKRRGRDPEMGGKPRRKNPQEGLYNELQKDKMA EAYSEIGMKGERRRGKHDGLYQGLSTATKDTYDALHMQALP PR | 632 |
| | 12A2-RSRQR | MALPVTALLLPLALLLHAARPGGGGSCPYSNPSLCSGGGGSGG GGSQVQLQESGPGLVKPSQSLSLTCSVSGGSVSSdgYYWSWIRQ HPGKGLEWIGYIYYRRITDYNPSLKSRVNISLDTSKNQFSLKLSS VTAADTAVYYCARDFGWYFDLWGRGTLVAVSSGGGGSGGGG SGGGGSGGGGSDIQMTQSPSSLSASVGDRVTITCRASQDISNYLT WYQQKPGRVPEVLIYAASALQSGVPSRFSGSGSGTDFTLTISSLQ PEDVATYYCQNYNSAPRTFGQGTKVEIKGSGGGGSCPYSNPSLC SGGGGSELPTQGTFSNVSTNVSPAKPTTTACPYSNPSLCTTTPAP RPPTPAPTIASQPLSLRPEACRPAAGGAVHTRGLDFACDIYIWAP LAGTCGVLLLSLVITLYCKRGRKKLLYIFKQPFMRPVQTTQEED GCSCRFPEEEEGGCELRVKFSRSADAPAYQQGQNQLYNELNLG RREEYDVLDKRRGRDPEMGGKPRRKNPQEGLYNELQKDKMAE AYSEIGMKGERRRGKHDGLYQGLSTATKDTYDALHMQALPPR | 633 |
| | 12C5-RSRQR | MALPVTALLLPLALLLHAARPGGGGSCPYSNPSLCSGGGGSGG GGSEVELVESGGGMVQPGRSLRLSCAASGFTFSDYGMHWVRQ APGMGLEWVTVIWYDGSnKYYADSVKGRFTISRDNSKNTVFLQ MNSLRAEDTAVYYCARDEVGfvGAFDIWGQGTMVTVSSGGGG SGGGGSGGGGSGGGGSDIQLTQSPSFLSASVGDRVIITCRASQGI NSHLAWYQQKPGKAPKLLIYYASTLPSGVPSRFSGSGSGTEFTL TVTSLQPEDFATYYCQQLNHYPITFGQGTRLDINGSGGGGSCPY SNPSLCSGGGGSELPTQGTFSNVSTNVSPAKPTTTACPYSNPSLC TTTPAPRPPTPAPTIASQPLSLRPEACRPAAGGAVHTRGLDFACD IYIWAPLAGTCGVLLLSLVITLYCKRGRKKLLYIFKQPFMRPVQT TQEEDGCSCRFPEEEEGGCELRVKFSRSADAPAYQQGQNQLYN ELNLGRREEYDVLDKRRGRDPEMGGKPRRKNPQEGLYNELQK DKMAEAYSEIGMKGERRRGKHDGLYQGLSTATKDTYDALH MQALPPR | 634 |
| | 12C6-RSRQR | MALPVTALLLPLALLLHAARPGGGGSCPYSNPSLCSGGGGSGG GGSEVELVESGGGMVQPGRSLRLSCAASGFTFSDYGMHWVRQ APGMGLEWVTVIWYDGSnKYYADSVKGRFTISRDNSKNTVFLQ MNSLRAEDTAVYYCARDEVGfvGAFDIWGQGTMVTVSSGGGG SGGGGSGGGGSGGGGSDIQLTQSPSFLSASVGDRVIITCRASQGI NSHLAWYQQKPGKAPKLLIYYASTLPSGVPSRFSGSGSGTEFTL TVTSLQPEDFATYYCQQLNHYPITFGQGTRLEIKGSGGGGSCPY SNPSLCSGGGGSELPTQGTFSNVSTNVSPAKPTTTACPYSNPSLC | 677 |

TABLE 11C-continued

| Format | Clone Name | Full Amino Sequence | Seq ID NO: |
|---|---|---|---|
| | | TTTPAPRPPTPAPTIASQPLSLRPEACRPAAGGAVHTRGLDFACD IYIWAPLAGTCGVLLLSLVITLYCKRGRKKLLYIFKQPFMRPVQT TQEEDGCSCRFPEEEEGGCELRVKFSRSADAPAYQQGQNQLYN ELNLGRREEYDVLDKRRGRDPEMGGKPRRKNPQEGLYNELQK DKMAEAYSEIGMKGERRRGKHDGLYQGLSTATKDTYDALH MQALPPR | |
| | 8F8-RSRQR | MALPVTALLLPLALLLHAARPGGGGSCPYSNPSLCSGGGGSGG GGSQVQLQESGPGLVQPSETLSLTCTVSGGSISYYYWSWIRQPP GKGLEWIGNINYMGNTIYNPSLKSRVTISVDTSKDQFSLKLTSVS AADTAVYYCVRAEGSIDAFDFWGQGTLVAVSLGGGGSGGGGS GGGGSGGGGSDIQMTQSPSTLSASVGDRVTITCRASQSISSWLA WYQQKPGKAPKVLIYKASNLESGVPSRFSGSGSGTEFTLTISSLQ PDDFATYYCQQYNSYSCTFGQGTKLEIKGSGGGGSCPYSNPSLC SGGGGSELPTQGTFSNVSTNVSPAKPTTTACPYSNPSLCTTTPAP RPPTPAPTIASQPLSLRPEACRPAAGGAVHTRGLDFACDIYIWAP LAGTCGVLLLSLVITLYCKRGRKKLLYIFKQPFMRPVQTTQEED GCSCRFPEEEEGGCELRVKFSRSADAPAYQQGQNQLYNELNLG RREEYDVLDKRRGRDPEMGGKPRRKNPQEGLYNELQKDKMAE AYSEIGMKGERRRGKHDGLYQGLSTATKDTYDALHMQALPPR | 635 |

TABLE 11D

| Format | Clone Name | Full Amino Sequence | Seq ID NO: |
|---|---|---|---|
| RSR (FIG. 6D) | 4F11-RSR | MALPVTALLLPLALLLHAARPGGGGSCPYSNPSLCGGGGSQVT LKESGPVLVKPTETLTLTCTVSGFSLSNARMGVTWIRQPPGKAL EWLAHIFSNDEKSYSTSLKSRLTISKDTSKTQVVLTMTNMDPVD TATYYCARIRDYYDISSYYDYWGQGTLVSVSSGGGGSGGGGSG GGGSDIQMTQSPSAMSASVGDRVTITCRASQDISNYLAWFQQKP GKVPKRLIYAASSLQSGVPSRFSGSGSGTEFTLTISSLLPEDFATY YCLQLNSFPFTFGGGTKVEINGGGGSCPYSNPSLCGGGGSTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRRGKHDGLYQGLSTATKDTYDALHMQAL PPR | 636 |
| | 4F11-2-RSR | MALPVTALLLPLALLLHAARPGGGGSCPYSNPSLCGGGGSQVT LKESGPVLVKPTETLTLTCTVSGFSLSNARMGVTWIRQPPGKAL EWLAHIFSNDEKSYSTSLKSRLTISKDTSKTQVVLTMTNMDPVD TATYYCARIRDYYDISSYYDYWGQGTLVSVSSGGGGSGGGGSG GGGSGGGGSDIQMTQSPSAMSASVGDRVTITCRASQDISNYLA WFQQKPGKVPKRLIYAASSLQSGVPSRFSGSGSGTEFTLTISSLLP EDFATYYCLQLNSFPFTFGGGTKVEINGGGGSCPYSNPSLCGGG GSTTTPAPRPPTPAPTIASQPLSLRPEACRPAAGGAVHTRGLDFA CDIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKHDGLYQGLSTATKDTYDAL HMQALPPR | 678 |
| | P08F08-RSR | MALPVTALLLPLALLLHAARPGGGGSCPYSNPSLCGGGGSEVQ LVQSGAEVKKPGESLKISCKGSGYGFTSYWIGWVRQMPGKGLE WMGIIHPDDSDTKYSPSFQGQVTISADKSISTAYLQWSSLKASDT AMYYCASSYLRGLWGGYFDYWGQGTLVTVSSGGGGSGGGGS GGGGSGGGGSELQSVLTQPPSASGTPGQRVTISCSGSSSNIGSNY VNWYQQLPGTAPKLLIYGDYQRPSGVPDRFSGSKSGTSASLAIS GLRSEDEADYYCATRDDSLSGSVVFGTGTKLTVLGGGGSCPYS NPSLCGGGGSTTTPAPRPPTPAPTIASQPLSLRPEACRPAAGGAV HTRGLDFACDIYIWAPLAGTCGVLLLSLVITLYCKRGRKKLLYIF KQPFMRPVQTTQEEDGCSCRFPEEEEGGCELRVKFSRSADAPAY QQGQNQLYNELNLGRREEYDVLDKRRGRDPEMGGKPRRKNPQ EGLYNELQKDKMAEAYSEIGMKGERRRGKHDGLYQGLSTAT KDTYDALHMQALPPR | 637 |
| | 10A1-RSR | MALPVTALLLPLALLLHAARPGGGGSCPYSNPSLCGGGGSQVQ LQESGPGLVKPSETLSLTCTVSGGSISYYYWTWIRQPPGKGLEWI GHIYYSGSTNYNPSLKSRVTISIDTSKNLFSLKLSSVTAADTAVY YCARAEGSIDAFDFWGQGTMVTVSSGGGGSGGGGSGGGGSGG GGSDIQMTQSPSTLSASVGDRVTITCRASQSISTWLAWYQQKPG KAPKVLIYKASSLESGVPSRFSGSGSGTEFILTINSLQPDDFASYY | 638 |

TABLE 11D-continued

| Format | Clone Name | Full Amino Sequence | Seq ID NO: |
|---|---|---|---|
| | | CQQYKSYSHTFGQGTKLEIKGGGGSCPYSNPSLCGGGGSTTTPA PRPPTPAPTIASQPLSLRPEACRPAAGGAVHTRGLDFACDIYIWA PLAGTCGVLLLSLVITLYCKRGRKKLLYIFKQPFMRPVQTTQEE DGCSCRFPEEEEGGCELRVKFSRSADAPAYQQGQNQLYNELNL GRREEYDVLDKRRGRDPEMGGKPRRKNPQEGLYNELQKDKMA EAYSEIGMKGERRRGKHDGLYQGLSTATKDTYDALHMQALP PR | |
| | 11C1-RSR | MALPVTALLLPLALLLHAARPGGGGSCPYSNPSLCGGGGSQVQ LQESGPGLVKPSETLSLNCTVSGGSISYYYWTWIRQPPGKGLEW IGHVIYSGTTNYNPSLKSRVTISVDTSKNQFSLKLNSVTAADTAV YYCVRAEGSIDAFDLWGQGTMVTVSSGGGGSGGGGSGGGGSG GGGSDIQMTQSPSILSASVGDRVTITCRASQSVSSWLAWYQQKP GKAPKVLIYKASSLESGVPSRFSGTGSGTEFTLTISSLQSDDFATY YCQQYNTYSHTFGQGTKLEIKGGGGSCPYSNPSLCGGGGSTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRRGKHDGLYQGLSTATKDTYDALHMQAL PPR | 639 |
| | 11E1-RSR | MALPVTALLLPLALLLHAARPGGGGSCPYSNPSLCGGGGSQVQ LQESGPGLVKPLQTLSLTCTVSGGSISSdgYYWSWIRQNPGKGLE WIGYMYYSGSTYYNPSLKSRVTISVDTSKNQFSLKLRSVTAADT AVYYCTRDFGWYFDLWGRGTLVTVSSGGGGSGGGGSGGGGS GGGSDIQMTQSPSSLSASVGDSITITCRASQDIDNYLAWYQQKT GKVPKVLIYAASALQSGVPSRFSGSGSGTDFTLTISSLQPEDVAT YYCQNYNSGPRTFGQGTKVEIKGGGGSCPYSNPSLCGGGGSTTT PAPRPPTPAPTIASQPLSLRPEACRPAAGGAVHTRGLDFACDIYI WAPLAGTCGVLLLSLVITLYCKRGRKKLLYIFKQPFMRPVQTTQ EEDGCSCRFPEEEEGGCELRVKFSRSADAPAYQQGQNQLYNEL NLGRREEYDVLDKRRGRDPEMGGKPRRKNPQEGLYNELQKDK MAEAYSEIGMKGERRRGKHDGLYQGLSTATKDTYDALHMQ ALPPR | 640 |
| | 12A2-RSR | MALPVTALLLPLALLLHAARPGGGGSCPYSNPSLCGGGGSQVQ LQESGPGLVKPSQSLSLTCSVSGGSVSSdgYYWSWIRQHPGKGL EWIGYIYYRRITDYNPSLKSRVNISLDTSKNQFSLKLSSVTAADT AVYYCARDFGWYFDLWGRGTLVAVSSGGGGSGGGGSGGGGS GGGGSDIQMTQSPSSLSASVGDRVTITCRASQDISNYLTWYQQK PGRVPEVLIYAASALQSGVPSRFSGSGSGTDFTLTISSLQPEDVAT YYCQNYNSAPRTFGQGTKVEIKGGGGSCPYSNPSLCGGGGSTTT PAPRPPTPAPTIASQPLSLRPEACRPAAGGAVHTRGLDFACDIYI WAPLAGTCGVLLLSLVITLYCKRGRKKLLYIFKQPFMRPVQTTQ EEDGCSCRFPEEEEGGCELRVKFSRSADAPAYQQGQNQLYNEL NLGRREEYDVLDKRRGRDPEMGGKPRRKNPQEGLYNELQKDK MAEAYSEIGMKGERRRGKHDGLYQGLSTATKDTYDALHMQ ALPPR | 641 |
| | 12C5-RSR | MALPVTALLLPLALLLHAARPGGGGSCPYSNPSLCGGGGSEVEL VESGGGMVQPGRSLRLSCAASGFTFSDYGMHWVRQAPGMGLE WVTVIWYDGSNKYYADSVKGRFTISRDNSKNTVFLQMNSLRAE DTAVYYCARDEVGFVGAFDIWGQGTMVTVSSGGGGSGGGGSG GGGSGGGGSDIQLTQSPSFLSASVGDRVIITCRASQGINSHLAWY QQKPGKAPKLLIYYASTLPSGVPSRFSGSGSGTEFTLTVTSLQPE DFATYYCQQLNHYPITFGQGTRLDINGGGGSCPYSNPSLCGGGG STTTPAPRPPTPAPTIASQPLSLRPEACRPAAGGAVHTRGLDFAC DIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKHDGLYQGLSTATKDTYDAL HMQALPPR | 642 |
| | 12C6-RSR | MALPVTALLLPLALLLHAARPGGGGSCPYSNPSLCGGGGSEVEL VESGGGMVQPGRSLRLSCAASGFTFSDYGMHWVRQAPGMGLE WVTVIWYDGSNKYYADSVKGRFTISRDNSKNTVFLQMNSLRAE DTAVYYCARDEVGFVGAFDIWGQGTMVTVSSGGGGSGGGGSG GGGSGGGGSDIQLTQSPSFLSASVGDRVIITCRASQGINSHLAWY QQKPGKAPKLLIYYASTLPSGVPSRFSGSGSGTEFTLTVTSLQPE DFATYYCQQLNHYPITFGQGTRLEIKGGGGSCPYSNPSLCGGGG STTTPAPRPPTPAPTIASQPLSLRPEACRPAAGGAVHTRGLDFAC DIYIWAPLAGTCGVLLLSLVITLYCKRGRKKLLYIFKQPFMRPV QTTQEEDGCSCRFPEEEEGGCELRVKFSRSADAPAYQQGQNQL YNELNLGRREEYDVLDKRRGRDPEMGGKPRRKNPQEGLYNEL QKDKMAEAYSEIGMKGERRRGKHDGLYQGLSTATKDTYDAL HMQALPPR | 679 |

TABLE 11D-continued

| Format | Clone Name | Full Amino Sequence | Seq ID NO: |
|---|---|---|---|
| | 8F8-RSR | MALPVTALLLPLALLLHAARPGGGGSCPYSNPSLCGGGGSQVQ LQESGPGLVQPSETLSLTCTVSGGSISYYYWSWIRQPPGKGLEWI GNINYMGNTIYNPSLKSRVTISVDTSKDQFSLKLTSVSAADTAV YYCVRAEGSIDAFDFWGQGTLVAVSLGGGGSGGGGSGGGGSG GGGSDIQMTQSPSTLSASVGDRVTITCRASQSISSWLAWYQQKP GKAPKVLIYKASNLESGVPSRFSGSGSGTEFTLTISSLQPDDFAT YYCQQYNSYSCTFGQGTKLEIKGGGGSCPYSNPSLCGGGGSTTT PAPRPPTPAPTIASQPLSLRPEACRPAAGGAVHTRGLDFACDIYI WAPLAGTCGVLLLSLVITLYCKRGRKKLLYIFKQPFMRPVQTTQ EEDGCSCRFPEEEEGGCELRVKFSRSADAPAYQQGQNQLYNEL NLGRREEYDVLDKRRGRDPEMGGKPRRKNPQEGLYNELQKDK MAEAYSEIGMKGERRGKGHDGLYQGLSTATKDTYDALHMQ ALPPR | 643 |

TABLE 11E

| Format | Clone Name | Full Amino Sequence | Seq ID NO: |
|---|---|---|---|
| RSR-short (FIG. 6E) | 4F11-RSR-short | MALPVTALLLPLALLLHAARPGGGGSCPYSNPSLCGGGGSQVT LKESGPVLVKPTETLTLTCTVSGFSLSNARMGVTWIRQPPGKAL EWLAHIFSNDEKSYSTSLKSRLTISKDTSKTQVVLTMTNMDPVD TATYYCARIRDYYDISSYYDYWGQGTLVSVSSGGGGSGGGGSG GGGSDIQMTQSPSAMSASVGDRVTITCRASQDISNYLAWFQQKP GKVPKRLIYAASSLQSGVPSRFSGSGSGTEFTLTISSLLPEDFATY YCLQLNSFPFTFGGGTKVEINGGGGSCPYSNPSLCTTTPAPRPPT PAPTIASQPLSLRPEACRPAAGGAVHTRGLDFACDIYIWAPLAGT CGVLLLSLVITLYCKRGRKKLLYIFKQPFMRPVQTTQEEDGCSC RFPEEEEGGCELRVKFSRSADAPAYQQGQNQLYNELNLGRREE YDVLDKRRGRDPEMGGKPRRKNPQEGLYNELQKDKMAEAYSE IGMKGERRGKGHDGLYQGLSTATKDTYDALHMQALPPR | 644 |
| | 4F11-2-RSR-short | MALPVTALLLPLALLLHAARPGGGGSCPYSNPSLCGGGGSQVT LKESGPVLVKPTETLTLTCTVSGFSLSNARMGVTWIRQPPGKAL EWLAHIFSNDEKSYSTSLKSRLTISKDTSKTQVVLTMTNMDPVD TATYYCARIRDYYDISSYYDYWGQGTLVSVSSGGGGSGGGGSG GGGSGGGGSDIQMTQSPSAMSASVGDRVTITCRASQDISNYLA WFQQKPGKVPKRLIYAASSLQSGVPSRFSGSGSGTEFTLTISSLLP EDFATYYCLQLNSFPFTFGGGTKVEINGGGGSCPYSNPSLCTTTP APRPPTPAPTIASQPLSLRPEACRPAAGGAVHTRGLDFACDIYIW APLAGTCGVLLLSLVITLYCKRGRKKLLYIFKQPFMRPVQTTQE EDGCSCRFPEEEEGGCELRVKFSRSADAPAYQQGQNQLYNELN LGRREEYDVLDKRRGRDPEMGGKPRRKNPQEGLYNELQKDKM AEAYSEIGMKGERRGKGHDGLYQGLSTATKDTYDALHMQAL PPR | 680 |
| | P08F08-RSR-short | MALPVTALLLPLALLLHAARPGGGGSCPYSNPSLCGGGGSEVQ LVQSGAEVKKPGESLKISCKGSGYGFTSYWIGWVRQMPGKGLE WMGIIHPDDSDTKYSPSFQGQVTISADKSISTAYLQWSSLKASDT AMYYCASSYLRGLWGGYFDYWGQGTLVTVSSGGGGSGGGGS GGGGSGGGGSELQSVLTQPPSASGTPGQRVTISCSGSSSNIGSNY VNWYQQLPGTAPKLLIYGDYQRPSGVPDRFSGSKSGTSASLAIS GLRSEDEADYYCATRDDSLSGVVFGTGTKLTVLGGGGSCPYS NPSLCTTTPAPRPPTPAPTIASQPLSLRPEACRPAAGGAVHTRGL DFACDIYIWAPLAGTCGVLLLSLVITLYCKRGRKKLLYIFKQPF MRPVQTTQEEDGCSCRFPEEEEGGCELRVKFSRSADAPAYQQG QNQLYNELNLGRREEYDVLDKRRGRDPEMGGKPRRKNPQEGL YNELQKDKMAEAYSEIGMKGERRGKGHDGLYQGLSTATKDT YDALHMQALPPR | 645 |
| | 10A1-RSR-short | MALPVTALLLPLALLLHAARPGGGGSCPYSNPSLCGGGGSQVQ LQESGPGLVKPSETLSLTCTVSGGSISYYYWTWIRQPPGKGLEWI GHIYYSGSTNYNPSLKSRVTISIDTSKNLFSLKLSSVTAADTAVY YCARAEGSIDAFDFWGQGTMVTVSSGGGGSGGGGSGGGGSGG GGSDIQMTQSPSTLSASVGDRVTITCRASQSISTWLAWYQQKPG KAPKVLIYKASSLESGVPSRFSGSGSGTEFILTINSLQPDDFASYY CQQYKSYSHTFGQGTKLEIKGGGGSCPYSNPSLCTTTPAPRPPTP APTIASQPLSLRPEACRPAAGGAVHTRGLDFACDIYIWAPLAGT CGVLLLSLVITLYCKRGRKKLLYIFKQPFMRPVQTTQEEDGCSC RFPEEEEGGCELRVKFSRSADAPAYQQGQNQLYNELNLGRREE YDVLDKRRGRDPEMGGKPRRKNPQEGLYNELQKDKMAEAYSE IGMKGERRGKGHDGLYQGLSTATKDTYDALHMQALPPR | 646 |

TABLE 11E-continued

| Format | Clone Name | Full Amino Sequence | Seq ID NO: |
|---|---|---|---|
| | 11C1-RSR-short | MALPVTALLLPLALLLHAARPGGGGSCPYSNPSLCGGGGSQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSIDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 647 |
| | 11E1-RSR-short | MALPVTALLLPLALLLHAARPGGGGSCPYSNPSLCGGGGSQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 648 |
| | 12A2-RSR-short | MALPVTALLLPLALLLHAARPGGGGSCPYSNPSLCGGGGSQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 649 |
| | 12C5-RSR-short | MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 650 |
| | 12C6-RSR-short | MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR | 681 |
| | 8F8-RSR-short | MALPVTALLLPLALLLHAARPGGGGSCPYSNPSLCGGGGSQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSIDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRR | 651 |

TABLE 11E-continued

| Format | Clone Name | Full Amino Sequence | Seq ID NO: |
|---|---|---|---|
| | | EEYDVLDKRRGRDPEMGGKPRRKNPQEGLYNELQKDKMAEAY SEIGMKGERRRGKGHDGLYQGLSTATKDTYDALHMQALPPR | |

Testing was performed on: NTD control; the RSRQR format (shown above and schematically in FIG. 6C) of a 4F11 CAR; the SR2 format (shown above and schematically in FIG. 6B) of a P08F08 CAR; the R2S format (shown above and schematically in FIG. 6F) of a P08F08 CAR; and the RSR-short format (shown above and schematically in FIG. 6E) of a P08F08 CAR.

Figure 7:
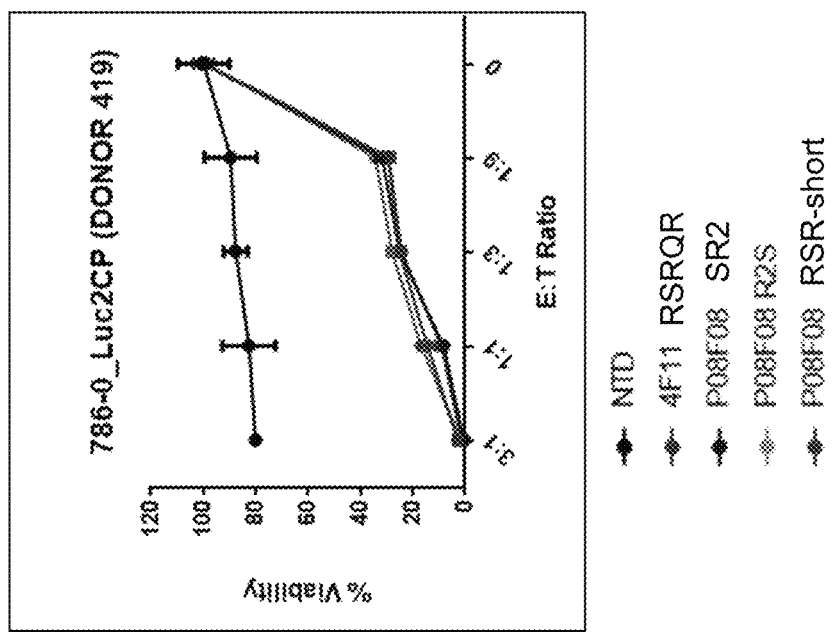
FIG. 7 shows viability of target cells after exposure to the CD70-specific CARs in four formats or non-transduced (NTD) control cells.

CAR T cells were generated that express each of the CAR formats. These CAR T cells were then thawed and mixed with 786-O target cells that are known to express CD70 at an effector:target (E:T) ratio of 3:1, 1:1, 1:3, or 1:9 (or 0 control) in RPMI supplemented with 10% FBS. Percentage lysis of target cells and fold expansion of effector CAR T cells were determined (FIG. 7).

Percentage lysis of target cells was calculated at each time-point by calculating the percentage of live 786-O cells for each CAR treatment and then normalizing to no treatment control. Fold expansion of CAR T cells over the number of CAR T cells plated on Day 0 was calculated at each time-point.

These results demonstrate that CD70-specific CAR-T cells expressing CD20 epitopes can kill target cells effectively at 3:1, 1:1, 1:3, and 1:9 E:T ratios, and ratios therebetween, as well as potentially at ratios outside 3:1 to 1:9 range not test in this experiment.

Part B: Sensitivity to Rituximab In Vivo

Depletion of CD70-specific CAR T cells following rituximab administration allows recovery of CD70-expressing lymphocytes in NSG mice The ability of the anti-CD20 antibody rituximab to mediate depletion of CD70-specific CAR T cells expressing CD20 epitopes and facilitate lymphocytes recovery is tested in mice. In this experiment, mice are treated with T cells expressing either a CD70-specific CAR that can bind to mouse CD70 protein on the surface of lymphocytes (α-mouse CD70 CAR Ts) and comprising a CD20 epitope recognized by rituximab or a control CAR, with negligible binding to mouse FLT3 protein. Flow cytometry analysis of lymphocytes is used to demonstrate CAR T cell cytotoxic activity against CD70-expressing lymphocytes, seen as a reduction of lymphocytes compared to mice that received control CAR T cells or to untreated mice. After confirmation of CAR T cell killing activity, mice are given rituximab for four consecutive days and circulating residual CAR T cells are enumerated by flow cytometry at day 13. The CD70-specific CAR T cells in the blood of these mice are depleted compared to the control group, which do not receive rituximab. Finally, flow cytometry analysis of lymphocytes demonstrates that only the mice that received rituximab (day 20) shows lymphocytes recovery.

This experiment demonstrates that rituximab-dependent depletion of CD70-specific CAR T cells that express CD20 epitopes mitigates damage to CD70-expressing tissues, allowing for rapid lymphocyte recovery.

Example 10: Activity of CD70-Specific CART Cells

Target cell killing was assessed using the same assay and similar experimental parameters to those described in Example 9, Part A. The tested cells lines were 786-0, ACHN, and REH (a human acute lymphocytic leukemia cell line). REH cell line shows the best differentiation of CD70-specific CAR T cells and hence will be used to rank scFvs in all future experiments. FIGS. 8A-8D show cell killing of 786-0 (FIG. 8A), ACHN (FIG. 8B), or REH (FIG. 8C) cells using CD70-specific CAR T cells where the CAR extracellular domain comprises the scFvs indicated in the legend (FIG. 8D). The naked CAR format was used for all experiments.

Table 12 provides the underlying data for FIGS. 8A-8D and additionally the measured percentage positive cells for fluorescently labeled anti-CD70 antibody, CD25 and 4-1BB (activation markers); the stem memory T cell (TSCM) percentage, the BFP percentage (CAR+) before going into the cytotoxicity assay.

TABLE 12

| Clone | % Lysis REH | % Lysis ACHN | % Lysis 786-O | % CD70 D 9 (gated on CAR) | % CD25 4-1BB D 9 (gated on CAR) | % Tscm D 14 (gated on CAR) | % BFP CAR D 14 |
|---|---|---|---|---|---|---|---|
| 12D6 | 98.5 | 75.4 | 84.6 | 0.7 | 15.1 | 17.2 | 77.4 |
| 8F8 | 98.1 | 84.7 | 94.8 | 0.0 | 26.1 | 28.9 | 70.5 |
| 12H4 | 97.7 | 65.8 | 80.5 | 0.1 | 16.9 | 31.5 | 83.8 |
| 12A2 | 97.5 | 76.1 | 89.3 | 3.9 | 6.2 | 46.5 | 73.2 |
| 12C5 | 97.5 | 81.7 | 91.6 | 0.0 | 31.1 | 24.7 | 88.2 |
| 10A1 | 97.2 | 77.0 | 88.3 | 0.1 | 21.5 | 31.4 | 73.5 |
| 11E1 | 96.8 | 84.7 | 94.5 | 0.2 | 34.8 | 20.4 | 54.8 |
| 12D3 | 96.0 | 63.8 | 75.4 | 7.5 | 14.2 | 35.0 | 71.0 |
| 4F11 | 96.0 | 73.4 | 85.6 | 4.3 | 44.0 | 15.7 | 36.3 |
| 12D7 | 95.7 | 84.9 | 92.7 | 1.2 | 48.5 | 5.4 | 43.1 |
| 11C1 | 95.6 | 76.9 | 90.0 | 0.5 | 31.8 | 30.3 | 57.9 |
| 11A1 | 73.5 | 46.0 | 64.6 | 2.4 | 7.0 | 41.6 | 82.5 |
| 9E10 | 71.7 | 77.1 | 90.0 | 68.2 | 21.7 | 25.2 | 63.9 |
| 8C8 | 70.7 | 80.7 | 90.2 | 76.6 | 12.9 | 26.3 | 57.6 |
| 10E2 | 59.2 | 41.5 | 36.9 | 52.0 | 6.4 | 28.1 | 34.8 |
| P08F08 | 45.8 | 78.0 | 94.5 | 30.6 | 7.8 | 48.4 | 43.1 |
| 8F7 | 38.6 | 39.3 | 55.4 | 46.4 | 3.0 | 32.3 | 63.5 |

TABLE 12-continued

| Clone | % Lysis REH | % Lysis ACHN | % Lysis 786-O | % CD70 D 9 (gated on CAR) | % CD25 4-1BB D 9 (gated on CAR) | % Tscm D 14 (gated on CAR) | % BFP CAR D 14 |
|---|---|---|---|---|---|---|---|
| 12F5 | 21.7 | 14.5 | 16.2 | 50.9 | 7.1 | 29.9 | 44.7 |
| 9E5 | 13.9 | 7.0 | 11.9 | 13.1 | 1.3 | 77.0 | 63.9 |
| 11D1 | 12.7 | −4.4 | 7.3 | 32.3 | 2.0 | 50.4 | 58.5 |
| 9F8 | 12.5 | 8.9 | 32.6 | 20.5 | 1.3 | 59.4 | 67.5 |
| 9F4 | 10.4 | 1.1 | 8.4 | 20.8 | 1.6 | 63.8 | 35.7 |
| 9D8 | 5.2 | 24.6 | 76.2 | 29.3 | 4.6 | 46.8 | 70.8 |
| NTD | 3.3 | 7.6 | 12.0 | | | | |

FIG. 9A shows the efficacy of CD70-specific CARs upon repeated exposure to luciferase-labeled 786-O target cells (CAR T cells were transferred to a 96-well plate containing fresh targets every 2-3 days). The E:T ratio was 3:1. The CARs were expressed in cells from donor D503. Similar to the results described in Example 4, target cell lysis in the stress test were used for in vitro characterization of CAR scFvs.

FIG. 9B shows the efficacy of CD70-specific CARs upon repeated exposure to luciferase-labeled ACHN target cells (CAR T cells were transferred to a 96-well plate containing fresh targets every 2-3 days). The E:T ratio was 10:1. The CARs were expressed in cells from donor D503. Similar to the results described in Example 4, target cell lysis in the stress test were used for in vitro characterization of CAR scFvs.

FIG. 9C shows the efficacy of CD70-specific CARs upon repeated exposure to luciferase-labeled REH target cells ($2 \times 10^6$ cells added at indicated time-points). The E:T ratio was 1:5. The CARs were expressed in cells from donor D503. Similar to the results described in Example 4, target cell lysis in the stress test were used for in vitro characterization of CAR scFvs.

Figure 10:
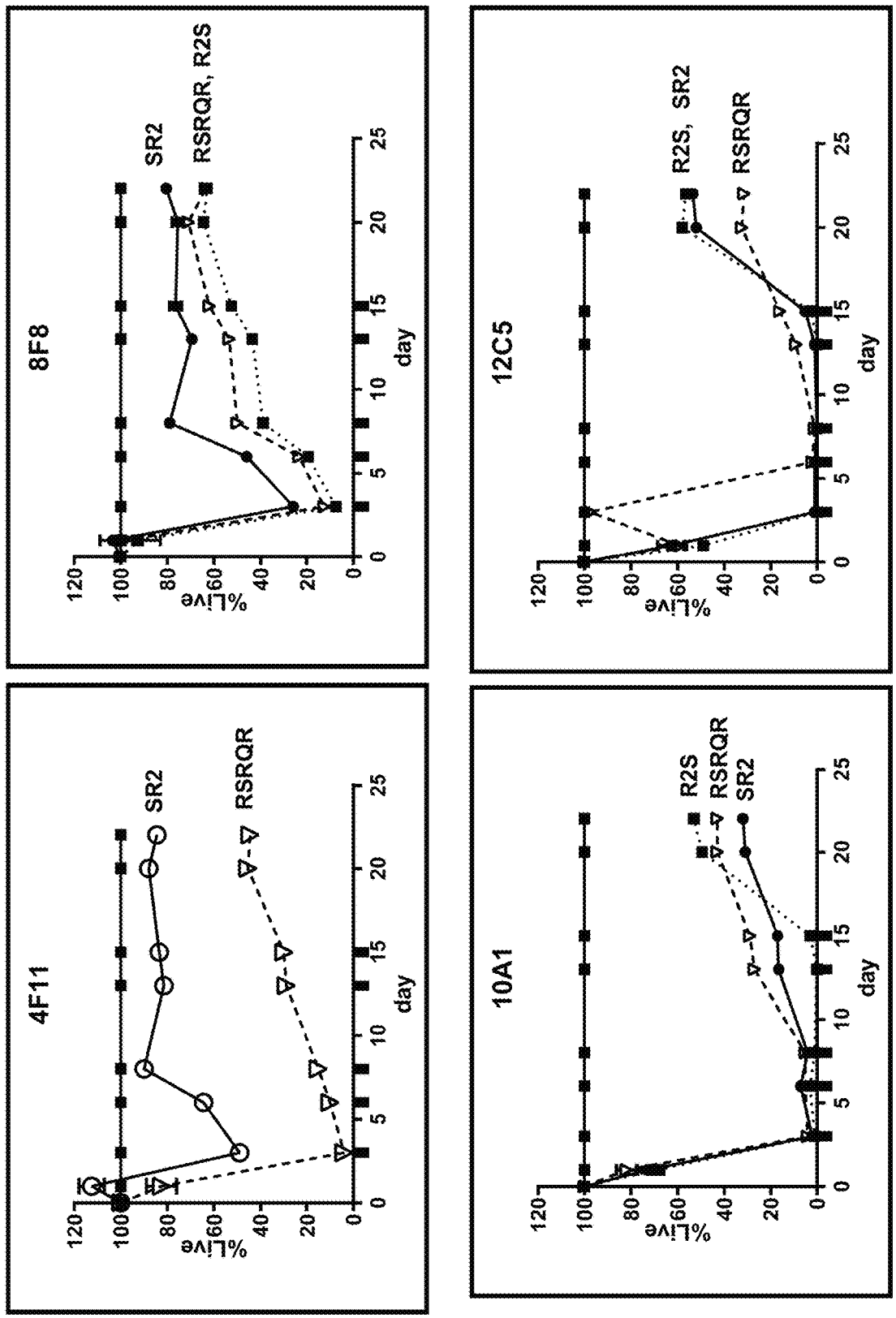
FIG. 10 is a series of plots showing the efficacy of CD70-specific CARs in either R2S, SR2, or RSRQR format upon repeated exposure to luciferase-labeled REH target cells ($2\times10^6$ cells added at indicated time-points). The E:T ratio was 1:5. The CARs were expressed in cells from donor D772.

FIG. 10 shows the efficacy of CD70-specific CARs in various formats (as mentioned in example 9 Part A) upon repeated exposure to luciferase-labeled REH target cells ($2 \times 10^6$ cells added at indicated time-points). The E:T ratio was 1:5. Similar to the results described in Example 4, target cell lysis in the stress test were used for in vitro characterization of CAR scFvs.

Example 11: In Vivo Comparison of CD70 CARs in ACHN Metastasis Model

CAR T cells containing different CD70 scFvs were generated and tested in ACHN cells, a renal cell cancer (RCC)-derived cell line. ACHN cells are described in Simmons et al. Animal Models of Bone Metastasis. *Veterinary Pathology* 52:827-841, 834 (2015). NSG mice were each implanted with 1 million ACHN tumor cells intravenously and 15 days post-tumor cell injection, the mice were treated with CAR T cells intravenously via tail vein injection to determine the CAR and condition with most optimal efficacy. 12C5 CAR T cells dosed at 3 million CAR+ cells per mouse showed the best efficacy.

Figure 11:
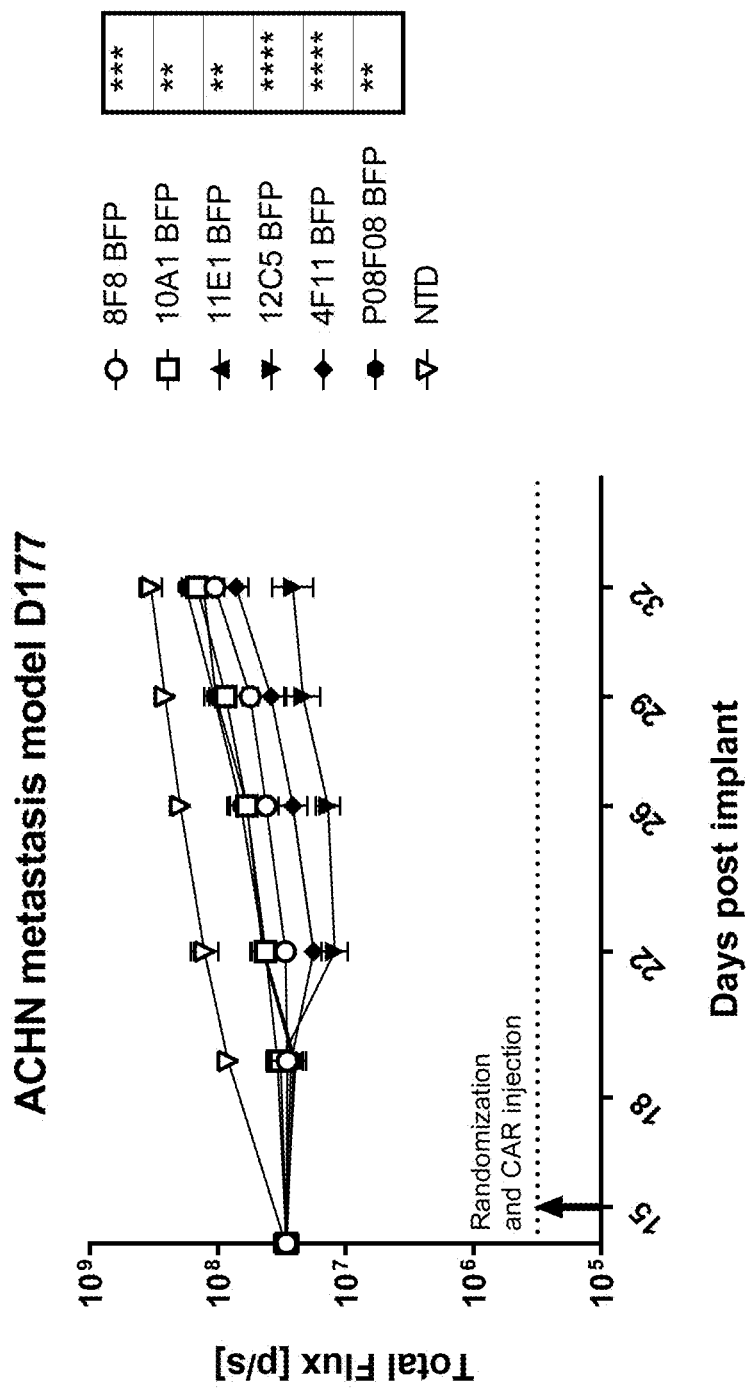
FIG. 11 is a plot showing tumor flux values of mice treated with control cells or cells expressing various CAR scFvs in the ACHN lung metastasis model.

Materials and Methods:

Forty-five NSG mice were prepared for intravenous tumor injection via tail vein. ACHN tumor cells that are known to express CD70 were expanded in MEM supplemented with 10% FBS. On Day 0, ACHN tumor cells were resuspended in serum-free MEM at the required concentration to inject 1 million cells per animal. ACHN tumor cells were injected in 200 uL of serum-free MEM intravenously. Day 4 baseline body weights were recorded for all animals. Tumor flux was measured twice a week starting on Day 7 using bioluminescence (IVIS Spectrum Imager™ from PerkinElmer™; auto-exposure with a maximum exposure time of 120 seconds), and body weights were recorded. On Day 20, when the tumors attained 200 mm³ (standard error 9.69), 35 tumor-bearing mice were randomized to 7 groups of 5 mice each. On Day 15, CAR T cells were thawed in MEM supplemented with 10% FBS and resuspended in serum-free MEM at 3 million CAR+ T cells per animal (calculated based on individual transduction efficiencies). Number of NTD cells required to maintain equal percentage of CAR+ T cells as well as equal number of total T cells in each group were calculated and added to respective samples. CAR T cells or NTD control were injected in 200 uL of serum-free MEM per animal intravenously via tail vein. Tumor flux was measured and body weights recorded twice a week till Day 32 when the NTD group reached the study end-point (' 20% body weight loss) (See FIG. 11).

Bioluminescence (mean and error SEM) were plotted on GraphPad Prism and statistics were calculated using one-way ANOVA with repeated measures. 12C5 CAR T group showed anti-tumor efficacy at the 3 million CAR+ dose.

Example 12: Expression Levels of CD70 on Patient-Derived RCC Samples and Lysis of Patient-Derived RCC Samples by CD70-Specific CAR T Cells Primary RCC patient samples were obtained from Conversant Bio (frozen dissociated tumor cells) or from CHTN Western/NDRI (fresh tumor fragments which were then dissociated in house using Miltenyi MACS human tumor dissociation kit and GentleMACS). Primary tumor cells were maintained in RPMI supplemented with 20% FBS. To determine cell surface expression of CD70 protein in these cells along with relevant RCC cell lines, we performed flow cytometry and receptor quantification using anti-CD70 antibody conjugated to Phycoerythrin at a 1:1 ratio. Cell surface receptors were calculated using Quantibrite beads from BD Biosciences and antibody binding capacity (ABC) values were calculated as per manufacturer's recommendation. CD70-specific CAR T cells were generated as previously described and their cytotoxicity against primary RCC cells and ACHN RCC cell line was assessed using the same assay and similar experimental parameters to those described in Example 9, Part A.

Results

Figure 12B:
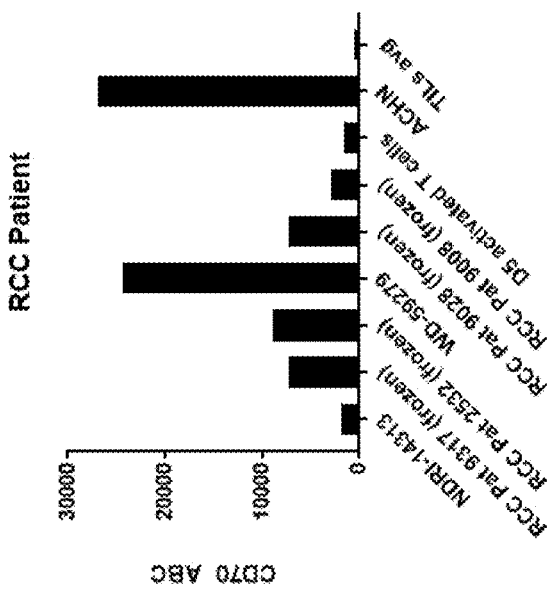
FIGS. 12A-12C is a series of plots showing the quantification of CD70 expression in terms of CD70 antibody binding capacity (ABC) on various tested cell lines or cell lines and RCC patient-derived cells. The data from RCC patient-derived cells is also shown.
Figure 12A:
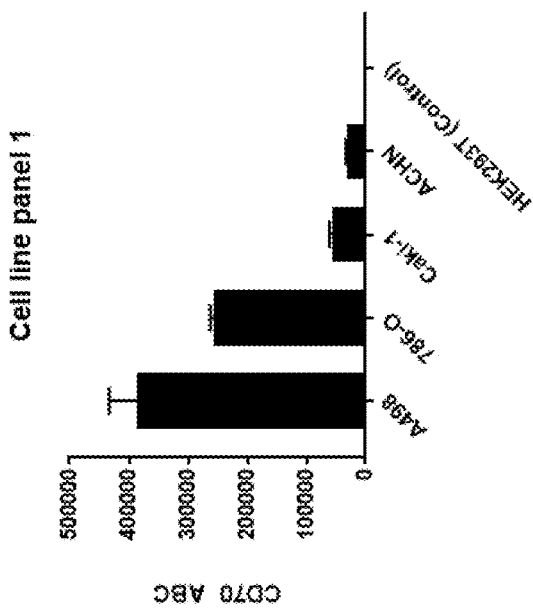
Figure 12C:
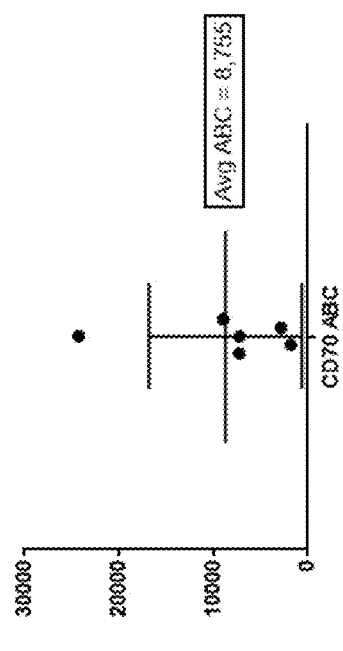
Figures 13A, 13B, 13C:
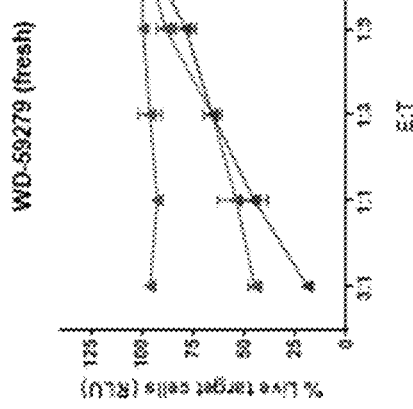
FIGS. 13A-13C is a series of plots showing killing of target cells from RCC patient WD-59279, patient-derived cell lines, or ACHN and antibody binding capacity is indicated in each panel.

It was confirmed that primary RCC cells express CD70 across ABC values ranging from 2,000 CD70 receptors per cell (receptors/cell) to ~25,000 receptors/cell (FIG. 12B) with expression on RCC cell lines ranging from ~25,000 receptors/cell to ~400,000 receptors/cell (FIG. 12A). We also confirmed that cells expressing 7,000 CD70 receptors per cell (receptors/cell) (FIG. 13B), 24,000 receptors/cell (FIG. 13A), or 40,000 receptors/cell (FIG. 13C) are effectively killed by CD70-specific CAR T cells, where the CAR is generated from either the 4F11 or P08F08 scFv.

Example 13: Expression Levels of CD70 on Various Hematological Tumor Cell Lines and Lysis of these Cells by CD70-Specific CAR T Cells The potential to target CD70 across a range of heme tumors including lymphomas, leukemias, and myeloma was characterized. Characterization included expression analysis of both CD70 RNA and cell surface protein in multiple malignancies, followed by efficacy of CAR T cells against cell lines.

Results

Figure 14A:
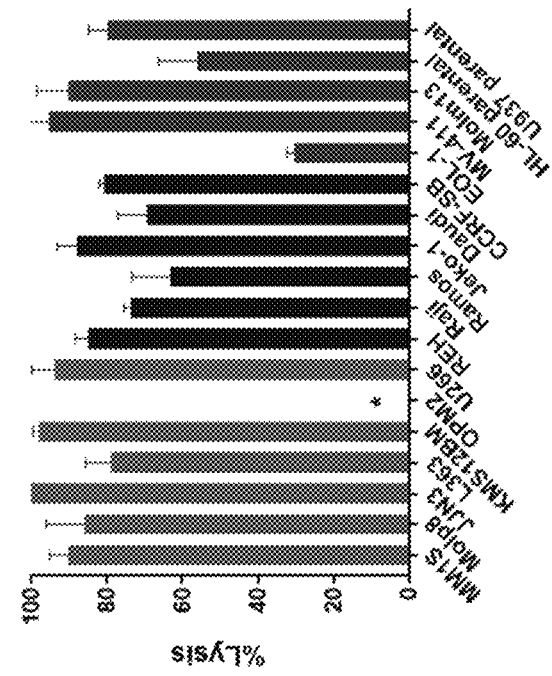
FIGS. 14A-14B is a series of bar graphs showing quantification of CD70 receptor numbers and heme tumor-cell killing by 4F11 CAR in the QR3 format at 1:1 E:T for further cell lines expressing CD70 at varied levels.
Figure 14B:
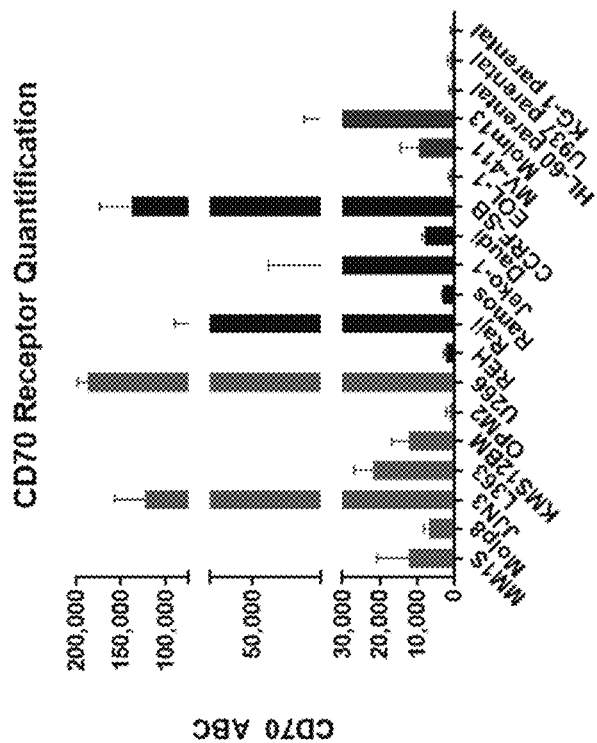
Figures 15A, 15B:
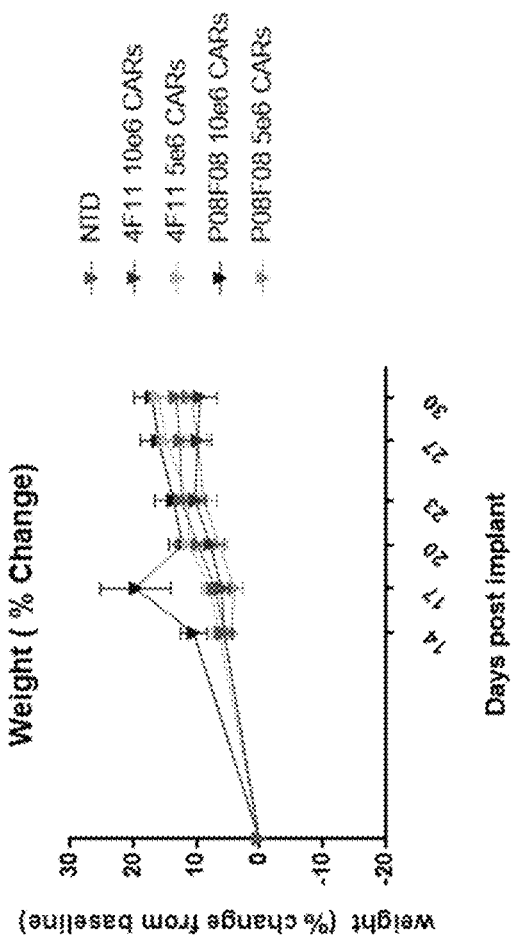
FIGS. 15A-15B show is a series of plots showing tumor volumes and body weights of mice treated with 4F11 and P08F08 CAR T at $10\times10^6$ cell or $5\times10^6$ cell dose in a subcutaneous xenograft model.

Analysis of RNA expression across acute myeloid leukemia (AML), acute lymphoblastic leukemia (ALL), non-Hodkins lymphoma (NHL), and multiple myeloma (MM cell) lines using The Cancer Genome Atlas (TCGA) shows that CD70 expression can be observed across all 4 cancer types indicating the potential utility of targeting these cancers with CD70 CAR T cells. To determine cell surface expression of CD70 protein in these cancers, we performed flow cytometry and receptor quantification on a panel of cell lines originating from the selected tumor types. Cell surface protein expression patterns were similar to RNA analyses confirming that CD70 expression was broadly observed in cell lines from all tumor types (FIG. 14A). Next we generated CD70-specific CAR T cells to test their efficacy in an in vitro cytotoxicity assay against the same cell lines. CD70 CAR T cells exhibited robust specific activity against target cells expressing the CD70 antigen (FIG. 14B). Various cell lines can be killed by a CD70-specific CAR (FIG. 14B), indicating that CD70-specific CARs can kill even cells that expression CD70 at a low level. This demonstrates that the activity of the CD70-specific CARs is not restricted to particular cell types. Finally, we showed that these CARs are effective against the MM1S cell line in the in vivo assay performed as in Example 7 (FIGS. 15A and 15B). MM1S is a multiple-myeloma cell line expressing a moderate number of CD70 receptors per cell (FIG. 14A). In conclusion, it was observed that CD70 has a broad expression profile across a range of hematological malignancies. Using CD70 CAR T cells either alone or in combination with the other heme targets offers opportunity to target or prevent tumor antigen escape in a wide range of hematologic malignancies.

Example 14: Determination of Kinetics and Affinity of Human CD70/CD70 Antibodies Interactions at 37° C.

This example determines the binding kinetics and/or affinity of various anti-CD70 antibodies toward human CD70. ScFvs were generated by cloning the variable regions of the anti-CD70 antibodies flanking a (GGGGS)$_4$ linker (SEQ ID NO: 602) then part of the hinge and Fc from a modified human IgG2 sequence resulting in a scFv-Fc fusion which was expressed using Expi293 then purified by Protein A affinity chromatography. Recombinant human CD70 was generated by fusing an AviTag™, a polyhistidine tag and a trimerization domain from chicken tenascin to the N-terminus of the human CD70 extracellular domain (ECD) which was expressed using Expi293 then purified by immobilized metal affinity chromatography (IMAC) followed by size exclusion chromatography (SEC) as needed.

The antibody binding kinetics were determined by surface plasmon resonance (Biacore 8K, GE Healthcare Bio-Sciences, Pittsburgh Pa.) at 37° C. in HBS-T+ (0.01 M HEPES pH 7.4, 0.15 M NaCl, 0.05% v/v Tween20, 1 mg/mL BSA). Recombinant human CD70 diluted in HBS-T+ was captured on a C1 chip immobilized with an anti-AviTag™ antibody. Purified anti-CD70 scFv-Fc fusions were serially diluted into HBS-T+, injected at 30 uL/min for 2-4 min, dissociation monitored for 10 min then the surface regenerated with 75 mM phosphoric acid between injections. Buffer cycles were collected for each anti-CD70 scFv-Fc fusion for double-referencing purposes (double-referencing as described in Myszka, D. G. Improving biosensor analysis. *J. Mol. Recognit.* 12, 279-284 (1999)). Kinetic association rates ($k_{on}$) and dissociation rates ($k_{off}$) were obtained simultaneously by fitting the double-referenced sensorgrams globally to a 1:1 Langmuir with mass transport model using Biacore 8K Evaluation Software (GE Healthcare Bio-Sciences, Pittsburgh Pa.) then used to calculate an equilibrium dissociation constant ($K_D$) from the kinetic rate constants ($K_D=k_{off}/k_{on}$). The data was fit to a 1:1 steady state affinity model using Biacore 8K Evaluation Software to determine a steady state equilibrium dissociation constant (SS $K_D$) as needed.

The binding kinetics and affinity parameters for the tested anti-CD70 antibodies are shown in Table 13. The antibodies shown in Table 13 share the same scFv sequence as the CARs shown in Tables 5 and 11 having the same name.

TABLE 13

| | scFv format | | | | |
|---|---|---|---|---|---|
| | $k_a$ (1/Ms) | $k_d$ (1/s) | $t_{1/2}$ (min) | $K_D$ (nM) | SS KD (nM) |
| 10A1 | 5.77E+05 | 7.73E−04 | 14.9 | 1.3 | |
| 10H10 | 4.62E+04 | 3.20E−03 | 3.6 | 69.3 | |
| 11C1 | 2.24E+05 | 1.86E−04 | 62.2 | 0.8 | |
| 11E1 | 5.78E+05 | 1.00E−03 | 11.6 | 1.7 | |
| 12A2 | — | — | — | Ambiguous | |
| 12C4 | 1.56E+06 | 4.55E−04 | 25.3 | 0.3 | |
| 12D6 | 7.12E+04 | 1.94E−03 | 5.9 | 27.3 | |
| 12D7 | 4.41E+05 | 7.55E−04 | 15.3 | 1.7 | |
| 17G6 | — | — | — | Weak binding | |
| 4F11 | 8.25E+05 | 1.60E−03 | 7.2 | 1.9 | |
| 8C8 | 1.03E+05 | 1.59E−03 | 7.3 | 15.4 | |
| 8F8 | 3.48E+05 | 7.93E−04 | 14.6 | 2.3 | |
| 9E10 | 8.25E+05 | 2.12E−03 | 5.4 | 2.6 | |
| P02B10 | — | — | — | | 355 |
| P07D03 | — | — | — | | 1070 |
| P08A02 | — | — | — | | 1200 |
| P08E02 | 8.23E+05 | 4.38E−03 | 2.6 | 5.3 | |
| P08F08 | 1.44E+06 | 1.53E−02 | 0.8 | 10.7 | |
| P08G02 | 2.39E+04 | 7.88E−03 | 1.5 | 330 | |
| P12B09 | 3.30E+05 | 1.35E−03 | 8.6 | 4.1 | |
| P12F02 | 2.75E+05 | 1.55E−03 | 7.4 | 5.7 | |
| P12G07 | — | — | — | Weak binding | |
| P13F04 | 9.77E+04 | 2.00E−02 | 0.6 | 205 | |
| P15D02 | 2.86E+05 | <8.05E− | >136 | <0.3 | |
| P16C05 | — | — | — | Weak binding | |

Although the disclosed teachings have been described with reference to various applications, methods, kits, and compositions, it will be appreciated that various changes and modifications can be made without departing from the teachings herein and the claimed invention below. The foregoing examples are provided to better illustrate the disclosed teachings and are not intended to limit the scope of the teachings presented herein. While the present teachings have been described in terms of these exemplary embodiments, the skilled artisan will readily understand that numerous variations and modifications of these exemplary embodiments are possible without undue experimentation. All such variations and modifications are within the scope of the current teachings.

All references cited herein, including patents, patent applications, papers, text books, and the like, and the references cited therein, to the extent that they are not already, are hereby incorporated by reference in their entirety. In the event that one or more of the incorporated literature and similar materials differs from or contradicts this application, including but not limited to defined terms, term usage, described techniques, or the like, this application controls.

The foregoing description and Examples detail certain specific embodiments of the disclosure and describes the best mode contemplated by the inventors. It will be appreciated, however, that no matter how detailed the foregoing may appear in text, the invention may be practiced in many ways and the invention should be construed in accordance with the appended claims and any equivalents thereof.

SEQUENCE LISTING (683 sequences)

SEQ ID NO: 1 - protein, 112 aa, Artificial Sequence
  Description of Artificial Sequence: Synthetic construct
DIVMTQNPLSSPVTLGQPASISCRSSQSLVHSDGNTYLSWLQQRPGQSPRLLIYKISNRFSGVPDRFSGSGAGTDFTLKISRVEAEDVGVYYCMQATQFPLTIGGGSKVEIK

SEQ ID NO: 2 - protein, 118 aa, Artificial Sequence
  Description of Artificial Sequence: Synthetic construct
QVQLVQSGAEVKKPGSSVKVSCKASGGTFSSYGFSWVRQAPGQGLEWMGGIIPIFGSANYAQKFQGRVTITADKSTSTVYMELISLRSEDTAVYYCARGGSSSPFAYWGQGTLVTVSS

SEQ ID NO: 3 - protein, 112 aa, Artificial Sequence
  Description of Artificial Sequence: Synthetic construct
DIVMTQTPLSSPVTLGQPASISCRSSQSLVHSDGNTYLSWLQQRPGQSPRLLIYKISNRFSGVPDRFSGSGAGTDFTLKISRVEAEDVGVYYCMQATQFPLTIGGGSKVEIK

SEQ ID NO: 4 - protein, 118 aa, Artificial Sequence
  Description of Artificial Sequence: Synthetic construct
QVQLVQSGAEVKKPGSSVKVSCKASGGTFSSYGFSWVRQAPGQGLEWMGGIIPIFGTANYAQKFQGRVTITADKSTSTVFMELISLRSEYTAVYYCARGGSSSPFAYWGQGTLVTVSS

SEQ ID NO: 5 - protein, 107 aa, Artificial Sequence
  Description of Artificial Sequence: Synthetic construct
DIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIK

SEQ ID NO: 6 - protein, 112 aa, Artificial Sequence
  Description of Artificial Sequence: Synthetic construct
QVQLQESGPGLVKPSETLSLTCTVSGGSISSYYWNWIRQPPGKGLEWIGYIYYSGSTNYNPSLKSRVTISVDTSKNQFSLKLRSVTAADTAVYYCARDIRTWGQGTLVTVSS

SEQ ID NO: 7 - protein, 112 aa, Artificial Sequence
  Description of Artificial Sequence: Synthetic construct
DVVMTQSPLSLPVTLGQPASISCRSSQSLVYSDENTYLNWFQQRPGQSLRRLIYQVSNRDSGVPDRFSGSGSGTDFTLKISRVEAEDVGVYFCMQGTYWPPTFGGGTKVEIK

SEQ ID NO: 8 - protein, 117 aa, Artificial Sequence
  Description of Artificial Sequence: Synthetic construct
EVQLVESGGGLVQPGGSLRLSCAASGFTFRNSWMSWVRQAPGKGLEWVANIKRDGSEKYYVDSVKGRFTISRDNAKNSLYLQMNSLRAEDTAVYYCARDQTGSFDYWGQGTLVTVSS

SEQ ID NO: 9 - protein, 106 aa, Artificial Sequence
  Description of Artificial Sequence: Synthetic construct
EIVMTQSPATLSMSLGERATLSCRASQSVSSSLAWYQQKPGQAPRLLIYGASTRATGIPARFGGSGSGTEFTLTISSLQSEDFAVYYCQQYINWPHFGGGTKVEIK

SEQ ID NO: 10 - protein, 115 aa, Artificial Sequence
  Description of Artificial Sequence: Synthetic construct
QVQLRGSGPGLVKPSETLSLTCTVSDDSISVYYWSWIRQPAGKGLEWIGRVYSSGNINYNPSLESRVTMSVDTSKSRFSLNLSSVTAADTAVYYCARGLDAFDIWGQGTMVTVSS

SEQ ID NO: 11 - protein, 107 aa, Artificial Sequence
  Description of Artificial Sequence: Synthetic construct
DIQMTQSPSSLSASVGDRVTITCQASQDISNYLNWYQQKPGKAPKILIYGASNLETGVPSRFSGSGSGTDFTFAISSLQPEDVATYYCQQYDNFPITFGQGTRLEIK

SEQ ID NO: 12 - protein, 115 aa, Artificial Sequence
  Description of Artificial Sequence: Synthetic construct
EVQLLESGGGLVQPGESLRLSCEVSGFTFTSYAMSWVRQVPGKGLEWVSIISGVAFTTYYADSVKGRFTISRDHSKNTLYLQMNGLRAEDTAVYYCVKVDGEVYWGQGTLVTVSS

SEQ ID NO: 13 - protein, 108 aa, Artificial Sequence
  Description of Artificial Sequence: Synthetic construct
EIVMTQSPDTLSVSPGERAILSCRASQSVSSNLAWYQQKPGQAPRLLIYSASTRASGIPARFSGSGSGTEFTLSISSLQSEDFAVYYCQQYDNWPPLTFGGGTKVEIK

SEQ ID NO: 14 - protein, 117 aa, Artificial Sequence
  Description of Artificial Sequence: Synthetic construct
QVQLVQSGAEVKKPGSSVKVSCEASGGTFITYAISWVRQAPGQGLEWMGGIIPFFGTANYAQKFQGRVTITADKSTSTASMELRSLRSEDTAMYYCAQWELFFFDFWGQGTPVTVSS

SEQ ID NO: 15 - protein, 108 aa, Artificial Sequence
  Description of Artificial Sequence: Synthetic construct
EIVLTQSPGTLSLSPGERATLSCRASQSVSSSYLAWYQQQPGQAPRLLIYGASSRATGIPDRFSGSGSGTDFTLTISRLEPEDFAIYYCQQYGSSPLTFGGGTKVEIK

SEQ ID NO: 16 - protein, 120 aa, Artificial Sequence
  Description of Artificial Sequence: Synthetic construct
AVQLVESGGGLVQPGGSLRLSCAASGFTFTYYSMNWVRQAPGKGLEWVSHISIRSSTIYFADSAKGRFTISRDNAKNSLYLQMNSLRDEDTAVYYCARGSGWYGDYFDYWGQGTLVTVSS

SEQ ID NO: 17 - protein, 107 aa, Artificial Sequence
  Description of Artificial Sequence: Synthetic construct
DIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEIN

SEQ ID NO: 18 - protein, 123 aa, Artificial Sequence
  Description of Artificial Sequence: Synthetic construct
QVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSS

SEQ ID NO: 19 - protein, 107 aa, Artificial Sequence
  Description of Artificial Sequence: Synthetic construct
DIQMTQSPSSVSASVGDRVTITCRASQGISSWLAWYQQKPGKAPKVLIYAASSLQSGVPSRFSGSGSGTDFTLTISSLQPEDFATYYCQQAFSFPFTFGPGTKVDIK

SEQ ID NO: 20 - protein, 119 aa, Artificial Sequence
  Description of Artificial Sequence: Synthetic construct
EVQLVESGGGLVQPGGSLRLSCAVSGFTFSNHNIHWVRQAPGKGLEWISYISRSSSTIYYADSVKGRFTISRDNAKNSLYLQMNSLRDEDTAVYYCARDHAQWYGMDVWGQGTTVTVSS

SEQ ID NO: 21 - protein, 112 aa, Artificial Sequence
  Description of Artificial Sequence: Synthetic construct
DIVMTQSPDSLAVSLGERATINCKSSQSVLYSYNNKNYVAWYQQKPGQPPNLLIFWASTRESGVPDRFSGSGSGTDFTLTISSLQAEDVAVYYCQQYYSTLTFGGGTKVEIK

SEQ ID NO: 22 - protein, 124 aa, Artificial Sequence
  Description of Artificial Sequence: Synthetic construct
EVQLVESGGGLVQPGGSLRLSCVASGFTFSSYWMSWVRQAPGKGLEWVASIKQDGSEKYYVDSVKGRFTISRDNAKNSVYLQMNSLRAEDTGVYYCAREGVNWGWRLYWHFDLWGRGTLVTVSS

SEQ ID NO: 23 - protein, 108 aa, Artificial Sequence
  Description of Artificial Sequence: Synthetic construct
EIVLTQSPGTLSLSPGERVTLSCRASQSVSSSYLAWYQQKPGQAPRLLIYDASSRATGIPDRFSGSGSGTDFTLTISRLEPEDFAVYYCQQYGSSPLTFGGGTKVEIK

SEQ ID NO: 24 - protein, 120 aa, Artificial Sequence
  Description of Artificial Sequence: Synthetic construct
EVQVVESGGGLVQPGGSLRLSCAASGFTFSSYSMNWVRQAPGKGLEWVSHSSISRGNIYFADSVKGRFTISRDNAKNSLYLQMNSLRDEDTAVYYCARGSGWYGDYFDYWGQGTLVTVSS

SEQ ID NO: 25 - protein, 112 aa, Artificial Sequence
  Description of Artificial Sequence: Synthetic construct
ELQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGVVFGGGTKLTVL

SEQ ID NO: 26 - protein, 120 aa, Artificial Sequence
  Description of Artificial Sequence: Synthetic construct
EVQLLESGGGLVQPGGSLRLSCAASGFAFSNYAMSWVRQAPGKGLEWVSAIRGGGGSTYYADSVKGRFTISRDNSKNTLYLQMNSLRAEDTAVYYCARDFISGTWYPDYWGQGTLVTVSS

SEQ ID NO: 27 - protein, 112 aa, Artificial Sequence
  Description of Artificial Sequence: Synthetic construct
ELQSVLTQPPSASGTPGQRVTISCSGSRSNIGSNYVYWYQQLPGTAPKLLIYRNNQRPSGVPDRFSGSKSGTSASLAISGLRSEDEADYYCASWDGSLSAVVFGTGTKLTVL

SEQ ID NO: 28 - protein, 122 aa, Artificial Sequence
  Description of Artificial Sequence: Synthetic construct
EVQLVQSGAEVKKPGESLKISCKGSGYRFTSYWIGWVRQMPGKGLEWMGSIYPDDSDTRYSPSFQGQVTISADKSISTAYLQWSSLKASDTAMYYCASSTVDYPGYSYFDYWGQGTLVTVSS

SEQ ID NO: 29 - protein, 112 aa, Artificial Sequence
  Description of Artificial Sequence: Synthetic construct
ELQSVLTQPPSASGTPGQRVTISCSGSSSNIGSNYVYWYQQLPGTAPKLLIYRNNQRPSGVPDRFSGSKSGTSASLAISGLRSEDEADYYCATWDDSLGSPVFGTGTKLTVL

SEQ ID NO: 30 - protein, 123 aa, Artificial Sequence
  Description of Artificial Sequence: Synthetic construct
EVQLVQSGAEVKKPGESLKISCKGSGYTFTNYWIAWVRQMPGKGLEWMGIIYPDGSDTRYSPSFQGQVTISADKSISTAYLQWSSLKASDTAMYYCARDITSWYYGEPAFDIWGQGTLVTVSS

SEQ ID NO: 31 - protein, 110 aa, Artificial Sequence
  Description of Artificial Sequence: Synthetic construct
ELDIQMTQSPSSLSASVGDRVTITCRASQSISRYLNWYQQKPGKAPKLLIYAASILQTGVPSRFSGSGSGTDFTLTISSLQPEDFATYYCQQSYSTTMWTFGQGTKVEIK

SEQ ID NO: 32 - protein, 122 aa, Artificial Sequence
  Description of Artificial Sequence: Synthetic construct
EVQLVQSGAEVKKPGESLKISCKGSGYSFTSSWIGWVRQMPGKGLEWMGIIYPGDSDTRYSPSFQGQVTISADKSISTAYLQWSSLKASDTAMYYCAKGLSQAMTGFGFDYWGQGTLVTVSS

SEQ ID NO: 33 - protein, 113 aa, Artificial Sequence
  Description of Artificial Sequence: Synthetic construct
ELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVL

SEQ ID NO: 34 - protein, 122 aa, Artificial Sequence
  Description of Artificial Sequence: Synthetic construct
EVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSS

SEQ ID NO: 35 - protein, 110 aa, Artificial Sequence
  Description of Artificial Sequence: Synthetic construct
ELDIQMTQSPSSLSASVGDRVTITCRASQSIYDYLHWYQQKPGKAPKLLIYDASNLQSGVPSRFSGSGSGTDFTLTISSLQPEDFATYYCQQSYTTPLFTFGQGTKVEIK

SEQ ID NO: 36 - protein, 126 aa, Artificial Sequence
  Description of Artificial Sequence: Synthetic construct
EVQLVQSGAEVKKPGESLKISCKGSGYTFPSSWIGWVRQMPGKGLEWMGIIYPDTSHTRYSPSFQGQVTISADKSISTAYLQWSSLKASDTAMYYCARASYFDRGTGYSSWWMDVWGQGTLVTVSS

SEQ ID NO: 37 - protein, 110 aa, Artificial Sequence
  Description of Artificial Sequence: Synthetic construct
ELDIQMTQSPSSLSASVGDRVTITCRASQYIGRYLNWYQQKRGKAPKLLIHGATSLASGVPSRFSGSGSGTDFTLTISSLQPEDFATYYCQQSYSTTSPTFGQGTKVEIK

SEQ ID NO: 38 - protein, 123 aa, Artificial Sequence
  Description of Artificial Sequence: Synthetic construct
EVQLLESGGGLVQPGGSLRLSCAASGFTFSQYSMSWVRQAPGKGLEWVSAISGGGVSTYYADSVKGRFTISRDNSKNTLYLQMNSLRAEDTAVYYCASDISDSGGSHWYFDYWGQGTLVTVSS

SEQ ID NO: 39 - protein, 112 aa, Artificial Sequence
  Description of Artificial Sequence: Synthetic construct
ELQSVLTQPPSASGTPGQRVTISCSGSTSNIGRNYVYWYQQLPGTAPKLLIYRTNQRPSGVPDRFSGSKSGTSASLAISGLRSEDEADYYCAAWDDSLSGRVFGTGTKLTVL

SEQ ID NO: 40 - protein, 121 aa, Artificial Sequence
  Description of Artificial Sequence: Synthetic construct
EVQLLESGGGLVQPGGSLRLSCAASGFTFSSYAMSWVRQAPGKGLEWVSTISGTGGTTYYADSVKGRFTISRDNSKNTLYLQMNSLRAEDTAVYYCAKVRAGIDPTASDVWGQGTLVTVSS

SEQ ID NO: 41 - protein, 112 aa, Artificial Sequence
  Description of Artificial Sequence: Synthetic construct
ELQSVLTQPPSASGTPGQRVTISCSGSSSNIGSNYVYWYQQLPGTAPKPLIYMNNQRPSGVPDRFSGSKSGTSASLAISGLRSEDEADYYCAAWDDSLSAVVFGTGTKLTVL

SEQ ID NO: 42 - protein, 124 aa, Artificial Sequence
  Description of Artificial Sequence: Synthetic construct
EVQLLESGGGLVQPGGSLRLSCAASGFTFNNFAMSWVRQAPGKGLEWVSGISGSGDNTYYADSVKGRFTISRDNSKNTLYLQMNSLRAEDTAVYYCAKDRDIGLGWYSYYLDVWGQGTLVTVSS

SEQ ID NO: 43 - protein, 113 aa, Artificial Sequence
  Description of Artificial Sequence: Synthetic construct
ELQSVLTQPPSASGTPGQRVTISCSGSNSNIGTNYVSWYQQLPGTAPKLLIYRSSRRPSGVPDRFSGSKSGTSASLAISGLRSEDEADYYCAAWDGSLSGHWVFGTGTKLTVL

SEQ ID NO: 44 - protein, 119 aa, Artificial Sequence
  Description of Artificial Sequence: Synthetic construct
QVQLVQSGAEVKKPGSSVKVSCKASGGTFSSYAISWVRQAPGQGLEWMGEIIPIFGTASYAQKFQGRVTITADESTSTAYMELSSLRSEDTAVYYCARAGWDDSWFDYWGQGTLVTVSS

SEQ ID NO: 45 - protein, 110 aa, Artificial Sequence
  Description of Artificial Sequence: Synthetic construct
ELDIQMTQSPSSLSASVGDRVTITCRASQSIDTYLNWYQQKPGKAPKLLIYSASSLHSGVPSRFSGSGSGTDFTLTISSLQPEDFATYYCQQSYSTTAWTFGQGTKVEIK

SEQ ID NO: 46 - protein, 122 aa, Artificial Sequence
  Description of Artificial Sequence: Synthetic construct
EVQLVQSGAEVKKPGESLKISCKGSGYSFASYWIGWVRQMPGKGLEWMGVIYPGTSETRYSPSFQGQVTISADKSISTAYLQWSSLKASDTAMYYCAKGLSASASGYSFQYWGQGTLVTVSS

SEQ ID NO: 47 - protein, 109 aa, Artificial Sequence
  Description of Artificial Sequence: Synthetic construct
ELDIQMTQSPSSLSASVGDRVTITCRASQSIGQSLNWYQQKPGKAPKLLIYGASSLQSGVPSRFSGSGSGTDFTLTISSLQPEDFATYYCQQSYSTPITFGQGTKVEIK

SEQ ID NO: 48 - protein, 124 aa, Artificial Sequence
  Description of Artificial Sequence: Synthetic construct
EVQLVQSGAEVKKPGESLKISCKGSGYSFTDYWIGWVRQMPGKGLEWMGMISPGGSTTIYRPSFQGQVTISADKSISTAYLQWSSLKASDTAMYYCAREMYTGGYGGSWYFDYWGQGTLVTVSS

SEQ ID NO: 49 - protein, 5 aa, Artificial Sequence
  Description of Artificial Sequence: Synthetic construct
SYGFS

SEQ ID NO: 50 - protein, 7 aa, Artificial Sequence
  Description of Artificial Sequence: Synthetic construct
GGTFSSY

SEQ ID NO: 51 - protein, 10 aa, Artificial Sequence
  Description of Artificial Sequence: Synthetic construct
GGTFSSYGFS

SEQ ID NO: 52 - protein, 17 aa, Artificial Sequence
  Description of Artificial Sequence: Synthetic construct
GIIPIFGSANYAQKFQG

SEQ ID NO: 53 - protein, 6 aa, Artificial Sequence
  Description of Artificial Sequence: Synthetic construct
IPIFGS

SEQ ID NO: 54 - protein, 9 aa, Artificial Sequence
  Description of Artificial Sequence: Synthetic construct
GGSSSPFAY

SEQ ID NO: 55 - protein, 5 aa, Artificial Sequence
  Description of Artificial Sequence: Synthetic construct
SYGFS

SEQ ID NO: 56 - protein, 7 aa, Artificial Sequence
  Description of Artificial Sequence: Synthetic construct
GGTFSSY

SEQ ID NO: 57 - protein, 10 aa, Artificial Sequence
  Description of Artificial Sequence: Synthetic construct
GGTFSSYGFS

SEQ ID NO: 58 - protein, 17 aa, Artificial Sequence
  Description of Artificial Sequence: Synthetic construct
GIIPIFGTANYAQKFQG

SEQ ID NO: 59 - protein, 6 aa, Artificial Sequence
  Description of Artificial Sequence: Synthetic construct
IPIFGT

SEQ ID NO: 60 - protein, 9 aa, Artificial Sequence
  Description of Artificial Sequence: Synthetic construct
GGSSSPFAY

SEQ ID NO: 61 - protein, 5 aa, Artificial Sequence
  Description of Artificial Sequence: Synthetic construct
SYYWN

SEQ ID NO: 62 - protein, 7 aa, Artificial Sequence
  Description of Artificial Sequence: Synthetic construct
GGSISSY

SEQ ID NO: 63 - protein, 10 aa, Artificial Sequence
  Description of Artificial Sequence: Synthetic construct
GGSISSYYWN

SEQ ID NO: 64 - protein, 16 aa, Artificial Sequence
  Description of Artificial Sequence: Synthetic construct
YIYYSGSTNYNPSLKS

SEQ ID NO: 65 - protein, 5 aa, Artificial Sequence
  Description of Artificial Sequence: Synthetic construct
YYSGS

SEQ ID NO: 66 - protein, 5 aa, Artificial Sequence
  Description of Artificial Sequence: Synthetic construct
DIRTW

SEQ ID NO: 67 - protein, 5 aa, Artificial Sequence
  Description of Artificial Sequence: Synthetic construct
NSWMS

SEQ ID NO: 68 - protein, 7 aa, Artificial Sequence
  Description of Artificial Sequence: Synthetic construct
GFTFRNS

SEQ ID NO: 69 - protein, 10 aa, Artificial Sequence
  Description of Artificial Sequence: Synthetic construct
GFTFRNSWMS

SEQ ID NO: 70 - protein, 17 aa, Artificial Sequence
  Description of Artificial Sequence: Synthetic construct
NIKRDGSEKYYVDSVKG

SEQ ID NO: 71 - protein, 6 aa, Artificial Sequence
  Description of Artificial Sequence: Synthetic construct
KRDGSE

SEQ ID NO: 72 - protein, 8 aa, Artificial Sequence
  Description of Artificial Sequence: Synthetic construct
DQTGSFDY

SEQ ID NO: 73 - protein, 5 aa, Artificial Sequence
  Description of Artificial Sequence: Synthetic construct
VYYWS

SEQ ID NO: 74 - protein, 7 aa, Artificial Sequence
  Description of Artificial Sequence: Synthetic construct
DDSISVY

SEQ ID NO: 75 - protein, 10 aa, Artificial Sequence
  Description of Artificial Sequence: Synthetic construct
DDSISVYYWS

SEQ ID NO: 76 - protein, 15 aa, Artificial Sequence
  Description of Artificial Sequence: Synthetic construct
VYSSGNINYNPSLES

SEQ ID NO: 77 - protein, 5 aa, Artificial Sequence
  Description of Artificial Sequence: Synthetic construct
YSSGN

SEQ ID NO: 78 - protein, 7 aa, Artificial Sequence
  Description of Artificial Sequence: Synthetic construct
GLDAFDI

SEQ ID NO: 79 - protein, 5 aa, Artificial Sequence
  Description of Artificial Sequence: Synthetic construct
SYAMS

SEQ ID NO: 80 - protein, 7 aa, Artificial Sequence
  Description of Artificial Sequence: Synthetic construct
GFTFTSY

SEQ ID NO: 81 - protein, 10 aa, Artificial Sequence
  Description of Artificial Sequence: Synthetic construct
GFTFTSYAMS

SEQ ID NO: 82 - protein, 16 aa, Artificial Sequence
  Description of Artificial Sequence: Synthetic construct
RVYSSGNINYNPSLES

SEQ ID NO: 83 - protein, 5 aa, Artificial Sequence
  Description of Artificial Sequence: Synthetic construct
YSSGN

SEQ ID NO: 84 - protein, 7 aa, Artificial Sequence
  Description of Artificial Sequence: Synthetic construct
GLDAFDI

SEQ ID NO: 85 - protein, 5 aa, Artificial Sequence
  Description of Artificial Sequence: Synthetic construct
TYAIS

SEQ ID NO: 86 - protein, 7 aa, Artificial Sequence
  Description of Artificial Sequence: Synthetic construct
GGTFITY

SEQ ID NO: 87 - protein, 10 aa, Artificial Sequence
  Description of Artificial Sequence: Synthetic construct
GGTFITYAIS

SEQ ID NO: 88 - protein, 17 aa, Artificial Sequence
  Description of Artificial Sequence: Synthetic construct
GIIPFFGTANYAQKFQG

SEQ ID NO: 89 - protein, 6 aa, Artificial Sequence
  Description of Artificial Sequence: Synthetic construct
IPFFGT

SEQ ID NO: 90 - protein, 8 aa, Artificial Sequence
  Description of Artificial Sequence: Synthetic construct
WELFFFDF

SEQ ID NO: 91 - protein, 5 aa, Artificial Sequence
  Description of Artificial Sequence: Synthetic construct
YYSMN

SEQ ID NO: 92 - protein, 7 aa, Artificial Sequence
  Description of Artificial Sequence: Synthetic construct
GFTFTYY

SEQ ID NO: 93 - protein, 10 aa, Artificial Sequence
  Description of Artificial Sequence: Synthetic construct
GFTFTYYSMN

SEQ ID NO: 94 - protein, 17 aa, Artificial Sequence
  Description of Artificial Sequence: Synthetic construct
HISIRSSTIYFADSAKG

SEQ ID NO: 95 - protein, 6 aa, Artificial Sequence
  Description of Artificial Sequence: Synthetic construct
SIRSST

SEQ ID NO: 96 - protein, 11 aa, Artificial Sequence
  Description of Artificial Sequence: Synthetic construct
GSGWYGDYFDY

SEQ ID NO: 97 - protein, 7 aa, Artificial Sequence
  Description of Artificial Sequence: Synthetic construct
NARMGVT

SEQ ID NO: 98 - protein, 9 aa, Artificial Sequence
  Description of Artificial Sequence: Synthetic construct
GFSLSNARM

SEQ ID NO: 99 - protein, 12 aa, Artificial Sequence
  Description of Artificial Sequence: Synthetic construct
GFSLSNARMGVT

SEQ ID NO: 100 - protein, 16 aa, Artificial Sequence
  Description of Artificial Sequence: Synthetic construct
HIFSNDEKSYSTSLKS

SEQ ID NO: 101 - protein, 5 aa, Artificial Sequence
  Description of Artificial Sequence: Synthetic construct
FSNDE

SEQ ID NO: 102 - protein, 13 aa, Artificial Sequence
  Description of Artificial Sequence: Synthetic construct
IRDYYDISSYYDY

SEQ ID NO: 103 - protein, 5 aa, Artificial Sequence
  Description of Artificial Sequence: Synthetic construct
NHNIH

SEQ ID NO: 104 - protein, 7 aa, Artificial Sequence
  Description of Artificial Sequence: Synthetic construct
GFTFSNH

SEQ ID NO: 105 - protein, 10 aa, Artificial Sequence
  Description of Artificial Sequence: Synthetic construct
GFTFSNHNIH

SEQ ID NO: 106 - protein, 17 aa, Artificial Sequence
  Description of Artificial Sequence: Synthetic construct
YISRSSSTIYYADSVKG

SEQ ID NO: 107 - protein, 6 aa, Artificial Sequence
  Description of Artificial Sequence: Synthetic construct
SRSSST

SEQ ID NO: 108 - protein, 10 aa, Artificial Sequence
  Description of Artificial Sequence: Synthetic construct
DHAQWYGMDV

SEQ ID NO: 109 - protein, 5 aa, Artificial Sequence
  Description of Artificial Sequence: Synthetic construct
SYWMS

SEQ ID NO: 110 - protein, 7 aa, Artificial Sequence
  Description of Artificial Sequence: Synthetic construct
GFTFSSY

SEQ ID NO: 111 - protein, 10 aa, Artificial Sequence
  Description of Artificial Sequence: Synthetic construct
GFTFSSYWMS

SEQ ID NO: 112 - protein, 17 aa, Artificial Sequence
  Description of Artificial Sequence: Synthetic construct
SIKQDGSEKYYVDSVKG

SEQ ID NO: 113 - protein, 6 aa, Artificial Sequence
  Description of Artificial Sequence: Synthetic construct
KQDGSE

SEQ ID NO: 114 - protein, 15 aa, Artificial Sequence
  Description of Artificial Sequence: Synthetic construct
EGVNWGWRLYWHFDL

SEQ ID NO: 115 - protein, 5 aa, Artificial Sequence
  Description of Artificial Sequence: Synthetic construct
SYSMN

SEQ ID NO: 116 - protein, 7 aa, Artificial Sequence
  Description of Artificial Sequence: Synthetic construct
GFTFSSY

SEQ ID NO: 117 - protein, 10 aa, Artificial Sequence
  Description of Artificial Sequence: Synthetic construct
GFTFSSYSMN

SEQ ID NO: 118 - protein, 17 aa, Artificial Sequence
  Description of Artificial Sequence: Synthetic construct
HSSISRGNIYFADSVKG

SEQ ID NO: 119 - protein, 6 aa, Artificial Sequence
  Description of Artificial Sequence: Synthetic construct
SISRGN

SEQ ID NO: 120 - protein, 11 aa, Artificial Sequence
  Description of Artificial Sequence: Synthetic construct
GSGWYGDYFDY

SEQ ID NO: 121 - protein, 5 aa, Artificial Sequence
  Description of Artificial Sequence: Synthetic construct
NYAMS

SEQ ID NO: 122 - protein, 7 aa, Artificial Sequence
  Description of Artificial Sequence: Synthetic construct
GFAFSNY

SEQ ID NO: 123 - protein, 10 aa, Artificial Sequence
  Description of Artificial Sequence: Synthetic construct
GFAFSNYAMS

SEQ ID NO: 124 - protein, 17 aa, Artificial Sequence
  Description of Artificial Sequence: Synthetic construct
AIRGGGGSTYYADSVKG

SEQ ID NO: 125 - protein, 6 aa, Artificial Sequence
  Description of Artificial Sequence: Synthetic construct
RGGGGS

SEQ ID NO: 126 - protein, 11 aa, Artificial Sequence
  Description of Artificial Sequence: Synthetic construct
DFISGTWYPDY

SEQ ID NO: 127 - protein, 5 aa, Artificial Sequence
  Description of Artificial Sequence: Synthetic construct
SYWIG

SEQ ID NO: 128 - protein, 7 aa, Artificial Sequence
  Description of Artificial Sequence: Synthetic construct
GYRFTSY

SEQ ID NO: 129 - protein, 10 aa, Artificial Sequence
  Description of Artificial Sequence: Synthetic construct
GYRFTSYWIG

SEQ ID NO: 130 - protein, 17 aa, Artificial Sequence
  Description of Artificial Sequence: Synthetic construct
SIYPDDSDTRYSPSFQG

SEQ ID NO: 131 - protein, 6 aa, Artificial Sequence
  Description of Artificial Sequence: Synthetic construct
YPDDSD

SEQ ID NO: 132 - protein, 13 aa, Artificial Sequence
  Description of Artificial Sequence: Synthetic construct
STVDYPGYSYFDY

SEQ ID NO: 133 - protein, 5 aa, Artificial Sequence
  Description of Artificial Sequence: Synthetic construct
NYWIA

SEQ ID NO: 134 - protein, 7 aa, Artificial Sequence
  Description of Artificial Sequence: Synthetic construct
GYTFTNY

SEQ ID NO: 135 - protein, 10 aa, Artificial Sequence
  Description of Artificial Sequence: Synthetic construct
GYTFTNYWIA

SEQ ID NO: 136 - protein, 17 aa, Artificial Sequence
  Description of Artificial Sequence: Synthetic construct
IIYPDGSDTRYSPSFQG

SEQ ID NO: 137 - protein, 6 aa, Artificial Sequence
  Description of Artificial Sequence: Synthetic construct
YPDGSD

SEQ ID NO: 138 - protein, 14 aa, Artificial Sequence
  Description of Artificial Sequence: Synthetic construct
DITSWYYGEPAFDI

SEQ ID NO: 139 - protein, 5 aa, Artificial Sequence
  Description of Artificial Sequence: Synthetic construct
SSWIG

SEQ ID NO: 140 - protein, 7 aa, Artificial Sequence
  Description of Artificial Sequence: Synthetic construct
GYSFTSS

SEQ ID NO: 141 - protein, 10 aa, Artificial Sequence
  Description of Artificial Sequence: Synthetic construct
GYSFTSSWIG

SEQ ID NO: 142 - protein, 17 aa, Artificial Sequence
  Description of Artificial Sequence: Synthetic construct
IIYPGDSDTRYSPSFQG

SEQ ID NO: 143 - protein, 6 aa, Artificial Sequence
  Description of Artificial Sequence: Synthetic construct
YPGDSD

SEQ ID NO: 144 - protein, 13 aa, Artificial Sequence
  Description of Artificial Sequence: Synthetic construct
GLSQAMTGFGFDY

SEQ ID NO: 145 - protein, 5 aa, Artificial Sequence
  Description of Artificial Sequence: Synthetic construct
SYWIG

SEQ ID NO: 146 - protein, 7 aa, Artificial Sequence
  Description of Artificial Sequence: Synthetic construct
GYGFTSY

SEQ ID NO: 147 - protein, 10 aa, Artificial Sequence
  Description of Artificial Sequence: Synthetic construct
GYGFTSYWIG

SEQ ID NO: 148 - protein, 17 aa, Artificial Sequence
  Description of Artificial Sequence: Synthetic construct
IIHPDDSDTKYSPSFQG

SEQ ID NO: 149 - protein, 6 aa, Artificial Sequence
  Description of Artificial Sequence: Synthetic construct
HPDDSD

SEQ ID NO: 150 - protein, 13 aa, Artificial Sequence
  Description of Artificial Sequence: Synthetic construct
SYLRGLWGGYFDY

SEQ ID NO: 151 - protein, 5 aa, Artificial Sequence
  Description of Artificial Sequence: Synthetic construct
SSWIG

SEQ ID NO: 152 - protein, 7 aa, Artificial Sequence
  Description of Artificial Sequence: Synthetic construct
GYTFPSS

SEQ ID NO: 153 - protein, 10 aa, Artificial Sequence
  Description of Artificial Sequence: Synthetic construct
GYTFPSSWIG

SEQ ID NO: 154 - protein, 16 aa, Artificial Sequence
  Description of Artificial Sequence: Synthetic construct
IIYPDTSHTRYSPSFQ

SEQ ID NO: 155 - protein, 6 aa, Artificial Sequence
  Description of Artificial Sequence: Synthetic construct
YPDTSH

SEQ ID NO: 156 - protein, 17 aa, Artificial Sequence
  Description of Artificial Sequence: Synthetic construct
ASYFDRGTGYSSWWMDV

SEQ ID NO: 157 - protein, 5 aa, Artificial Sequence
  Description of Artificial Sequence: Synthetic construct
QYSMS

SEQ ID NO: 158 - protein, 7 aa, Artificial Sequence
  Description of Artificial Sequence: Synthetic construct
GFTFSQY

SEQ ID NO: 159 - protein, 10 aa, Artificial Sequence
  Description of Artificial Sequence: Synthetic construct
GFTFSQYSMS

SEQ ID NO: 160 - protein, 17 aa, Artificial Sequence
  Description of Artificial Sequence: Synthetic construct
AISGGGVSTYYADSVKG

SEQ ID NO: 161 - protein, 6 aa, Artificial Sequence
  Description of Artificial Sequence: Synthetic construct
SGGGVS

SEQ ID NO: 162 - protein, 14 aa, Artificial Sequence
  Description of Artificial Sequence: Synthetic construct
DISDSGGSHWYFDY

SEQ ID NO: 163 - protein, 5 aa, Artificial Sequence
  Description of Artificial Sequence: Synthetic construct
SYAMS

SEQ ID NO: 164 - protein, 7 aa, Artificial Sequence
  Description of Artificial Sequence: Synthetic construct
GFTFSSY

SEQ ID NO: 165 - protein, 10 aa, Artificial Sequence
  Description of Artificial Sequence: Synthetic construct
GFTFSSYAMS

SEQ ID NO: 166 - protein, 17 aa, Artificial Sequence
  Description of Artificial Sequence: Synthetic construct
TISGTGGTTYYADSVKG

SEQ ID NO: 167 - protein, 6 aa, Artificial Sequence
  Description of Artificial Sequence: Synthetic construct
SGTGGT

SEQ ID NO: 168 - protein, 12 aa, Artificial Sequence
  Description of Artificial Sequence: Synthetic construct
VRAGIDPTASDV

SEQ ID NO: 169 - protein, 5 aa, Artificial Sequence
  Description of Artificial Sequence: Synthetic construct
NFAMS

SEQ ID NO: 170 - protein, 7 aa, Artificial Sequence
  Description of Artificial Sequence: Synthetic construct
GFTFNNF

SEQ ID NO: 171 - protein, 10 aa, Artificial Sequence
  Description of Artificial Sequence: Synthetic construct
GFTFNNFAMS

SEQ ID NO: 172 - protein, 17 aa, Artificial Sequence
  Description of Artificial Sequence: Synthetic construct
GISGSGDNTYYADSVKG

SEQ ID NO: 173 - protein, 6 aa, Artificial Sequence
  Description of Artificial Sequence: Synthetic construct
SGSGDN

SEQ ID NO: 174 - protein, 15 aa, Artificial Sequence
  Description of Artificial Sequence: Synthetic construct
DRDIGLGWYSYYLDV

SEQ ID NO: 175 - protein, 5 aa, Artificial Sequence
  Description of Artificial Sequence: Synthetic construct
SYAIS

SEQ ID NO: 176 - protein, 7 aa, Artificial Sequence
  Description of Artificial Sequence: Synthetic construct
GGTFSSY

SEQ ID NO: 177 - protein, 10 aa, Artificial Sequence
  Description of Artificial Sequence: Synthetic construct
GGTFSSYAIS

SEQ ID NO: 178 - protein, 17 aa, Artificial Sequence
  Description of Artificial Sequence: Synthetic construct
EIIPIFGTASYAQKFQG

SEQ ID NO: 179 - protein, 6 aa, Artificial Sequence
  Description of Artificial Sequence: Synthetic construct
IPIFGT

SEQ ID NO: 180 - protein, 10 aa, Artificial Sequence
  Description of Artificial Sequence: Synthetic construct
AGWDDSWFDY

SEQ ID NO: 181 - protein, 5 aa, Artificial Sequence
  Description of Artificial Sequence: Synthetic construct
SYWIG

SEQ ID NO: 182 - protein, 7 aa, Artificial Sequence
  Description of Artificial Sequence: Synthetic construct
GYSFASY

SEQ ID NO: 183 - protein, 10 aa, Artificial Sequence
  Description of Artificial Sequence: Synthetic construct
GYSFASYWIG

SEQ ID NO: 184 - protein, 17 aa, Artificial Sequence
  Description of Artificial Sequence: Synthetic construct
VIYPGTSETRYSPSFQG

SEQ ID NO: 185 - protein, 6 aa, Artificial Sequence
  Description of Artificial Sequence: Synthetic construct
YPGTSE

SEQ ID NO: 186 - protein, 13 aa, Artificial Sequence
  Description of Artificial Sequence: Synthetic construct
GLSASASGYSFQY

SEQ ID NO: 187 - protein, 5 aa, Artificial Sequence
  Description of Artificial Sequence: Synthetic construct
DYWIG

SEQ ID NO: 188 - protein, 7 aa, Artificial Sequence
  Description of Artificial Sequence: Synthetic construct
GYSFTDY

SEQ ID NO: 189 - protein, 10 aa, Artificial Sequence
  Description of Artificial Sequence: Synthetic construct
GYSFTDYWIG

SEQ ID NO: 190 - protein, 17 aa, Artificial Sequence
  Description of Artificial Sequence: Synthetic construct
MISPGGSTTIYRPSFQG

SEQ ID NO: 191 - protein, 6 aa, Artificial Sequence
  Description of Artificial Sequence: Synthetic construct
SPGGST

SEQ ID NO: 192 - protein, 14 aa, Artificial Sequence
  Description of Artificial Sequence: Synthetic construct
MYTGGYGGSWYFDY

SEQ ID NO: 193 - protein, 16 aa, Artificial Sequence
  Description of Artificial Sequence: Synthetic construct
RSSQSLVHSDGNTYLS

SEQ ID NO: 194 - protein, 7 aa, Artificial Sequence
  Description of Artificial Sequence: Synthetic construct
KISNRFS

SEQ ID NO: 195 - protein, 9 aa, Artificial Sequence
  Description of Artificial Sequence: Synthetic construct
MQATQFPLT

SEQ ID NO: 196 - protein, 16 aa, Artificial Sequence
  Description of Artificial Sequence: Synthetic construct
RSSQSLVHSDGNTYLS

SEQ ID NO: 197 - protein, 7 aa, Artificial Sequence
  Description of Artificial Sequence: Synthetic construct
KISNRFS

SEQ ID NO: 198 - protein, 9 aa, Artificial Sequence
  Description of Artificial Sequence: Synthetic construct
MQATQFPLT

SEQ ID NO: 199 - protein, 11 aa, Artificial Sequence
  Description of Artificial Sequence: Synthetic construct
RASQGISNYLA

SEQ ID NO: 200 - protein, 7 aa, Artificial Sequence
  Description of Artificial Sequence: Synthetic construct
AASSLQS

SEQ ID NO: 201 - protein, 9 aa, Artificial Sequence
  Description of Artificial Sequence: Synthetic construct
QQYNSYPLT

SEQ ID NO: 202 - protein, 16 aa, Artificial Sequence
  Description of Artificial Sequence: Synthetic construct
RSSQSLVYSDENTYLN

SEQ ID NO: 203 - protein, 7 aa, Artificial Sequence
  Description of Artificial Sequence: Synthetic construct
QVSNRDS

SEQ ID NO: 204 - protein, 9 aa, Artificial Sequence
  Description of Artificial Sequence: Synthetic construct
MQGTYWPPT

SEQ ID NO: 205 - protein, 11 aa, Artificial Sequence
  Description of Artificial Sequence: Synthetic construct
RASQSVSSSLA

SEQ ID NO: 206 - protein, 7 aa, Artificial Sequence
  Description of Artificial Sequence: Synthetic construct
GASTRAT

SEQ ID NO: 207 - protein, 8 aa, Artificial Sequence
  Description of Artificial Sequence: Synthetic construct
QQYINWPH

SEQ ID NO: 208 - protein, 11 aa, Artificial Sequence
  Description of Artificial Sequence: Synthetic construct
QASQDISNYLN

SEQ ID NO: 209 - protein, 7 aa, Artificial Sequence
  Description of Artificial Sequence: Synthetic construct
GASNLET

SEQ ID NO: 210 - protein, 9 aa, Artificial Sequence
  Description of Artificial Sequence: Synthetic construct
QQYDNFPIT

SEQ ID NO: 211 - protein, 11 aa, Artificial Sequence
  Description of Artificial Sequence: Synthetic construct
RASQSVSSNLA

SEQ ID NO: 212 - protein, 7 aa, Artificial Sequence
  Description of Artificial Sequence: Synthetic construct
SASTRAS

SEQ ID NO: 213 - protein, 10 aa, Artificial Sequence
  Description of Artificial Sequence: Synthetic construct
QQYDNWPPLT

SEQ ID NO: 214 - protein, 12 aa, Artificial Sequence
  Description of Artificial Sequence: Synthetic construct
RASQSVSSSYLA

SEQ ID NO: 215 - protein, 7 aa, Artificial Sequence
  Description of Artificial Sequence: Synthetic construct
GASSRAT

SEQ ID NO: 216 - protein, 9 aa, Artificial Sequence
  Description of Artificial Sequence: Synthetic construct
QQYGSSPLT

SEQ ID NO: 217 - protein, 11 aa, Artificial Sequence
  Description of Artificial Sequence: Synthetic construct
RASQDISNYLA

SEQ ID NO: 218 - protein, 7 aa, Artificial Sequence
  Description of Artificial Sequence: Synthetic construct
AASSLQS

SEQ ID NO: 219 - protein, 9 aa, Artificial Sequence
  Description of Artificial Sequence: Synthetic construct
LQLNSFPFT

SEQ ID NO: 220 - protein, 11 aa, Artificial Sequence
  Description of Artificial Sequence: Synthetic construct
RASQGISSWLA

SEQ ID NO: 221 - protein, 7 aa, Artificial Sequence
  Description of Artificial Sequence: Synthetic construct
AASSLQS

SEQ ID NO: 222 - protein, 9 aa, Artificial Sequence
  Description of Artificial Sequence: Synthetic construct
QQAFSFPFT

SEQ ID NO: 223 - protein, 17 aa, Artificial Sequence
  Description of Artificial Sequence: Synthetic construct
KSSQSVLYSYNNKNYVA

SEQ ID NO: 224 - protein, 7 aa, Artificial Sequence
  Description of Artificial Sequence: Synthetic construct
WASTRES

SEQ ID NO: 225 - protein, 8 aa, Artificial Sequence
  Description of Artificial Sequence: Synthetic construct
QQYYSTLT

SEQ ID NO: 226 - protein, 12 aa, Artificial Sequence
  Description of Artificial Sequence: Synthetic construct
RASQSVSSSYLA

SEQ ID NO: 227 - protein, 7 aa, Artificial Sequence
  Description of Artificial Sequence: Synthetic construct
DASSRAT

SEQ ID NO: 228 - protein, 9 aa, Artificial Sequence
  Description of Artificial Sequence: Synthetic construct
QQYGSSPLT

SEQ ID NO: 229 - protein, 13 aa, Artificial Sequence
  Description of Artificial Sequence: Synthetic construct
SGSSSNIGSNYVY

SEQ ID NO: 230 - protein, 7 aa, Artificial Sequence
  Description of Artificial Sequence: Synthetic construct
RNNQRPS

SEQ ID NO: 231 - protein, 11 aa, Artificial Sequence
  Description of Artificial Sequence: Synthetic construct
AAWDDSLSGVV

SEQ ID NO: 232 - protein, 13 aa, Artificial Sequence
  Description of Artificial Sequence: Synthetic construct
SGSRSNIGSNYVY

SEQ ID NO: 233 - protein, 7 aa, Artificial Sequence
  Description of Artificial Sequence: Synthetic construct
RNNQRPS

SEQ ID NO: 234 - protein, 11 aa, Artificial Sequence
  Description of Artificial Sequence: Synthetic construct
ASWDGSLSAVV

SEQ ID NO: 235 - protein, 13 aa, Artificial Sequence
  Description of Artificial Sequence: Synthetic construct
SGSSSNIGSNYVY

SEQ ID NO: 236 - protein, 7 aa, Artificial Sequence
  Description of Artificial Sequence: Synthetic construct
RNNQRPS

SEQ ID NO: 237 - protein, 11 aa, Artificial Sequence
  Description of Artificial Sequence: Synthetic construct
ATWDDSLGSPV

SEQ ID NO: 238 - protein, 11 aa, Artificial Sequence
  Description of Artificial Sequence: Synthetic construct
RASQSISRYLN

SEQ ID NO: 239 - protein, 7 aa, Artificial Sequence
  Description of Artificial Sequence: Synthetic construct
AASILQT

SEQ ID NO: 240 - protein, 10 aa, Artificial Sequence
  Description of Artificial Sequence: Synthetic construct
QQSYSTTMWT

SEQ ID NO: 241 - protein, 13 aa, Artificial Sequence
  Description of Artificial Sequence: Synthetic construct
SGSSSNIGSNYVN

SEQ ID NO: 242 - protein, 7 aa, Artificial Sequence
  Description of Artificial Sequence: Synthetic construct
GDYQRPS

SEQ ID NO: 243 - protein, 12 aa, Artificial Sequence
  Description of Artificial Sequence: Synthetic construct
ATRDDSLSGSVV

SEQ ID NO: 244 - protein, 11 aa, Artificial Sequence
  Description of Artificial Sequence: Synthetic construct
RASQSIYDYLH

SEQ ID NO: 245 - protein, 7 aa, Artificial Sequence
  Description of Artificial Sequence: Synthetic construct
DASNLQS

SEQ ID NO: 246 - protein, 10 aa, Artificial Sequence
  Description of Artificial Sequence: Synthetic construct
QQSYTTPLFT

SEQ ID NO: 247 - protein, 11 aa, Artificial Sequence
  Description of Artificial Sequence: Synthetic construct
RASQYIGRYLN

SEQ ID NO: 248 - protein, 7 aa, Artificial Sequence
  Description of Artificial Sequence: Synthetic construct
GATSLAS

SEQ ID NO: 249 - protein, 10 aa, Artificial Sequence
  Description of Artificial Sequence: Synthetic construct
QQSYSTTSPT

SEQ ID NO: 250 - protein, 13 aa, Artificial Sequence
  Description of Artificial Sequence: Synthetic construct
SGSTSNIGRNYVY

SEQ ID NO: 251 - protein, 7 aa, Artificial Sequence
  Description of Artificial Sequence: Synthetic construct
RTNQRPS

SEQ ID NO: 252 - protein, 11 aa, Artificial Sequence
  Description of Artificial Sequence: Synthetic construct
AAWDDSLSGRV

SEQ ID NO: 253 - protein, 13 aa, Artificial Sequence
  Description of Artificial Sequence: Synthetic construct
SGSSSNIGSNYVY

SEQ ID NO: 254 - protein, 7 aa, Artificial Sequence
  Description of Artificial Sequence: Synthetic construct
MNNQRPS

SEQ ID NO: 255 - protein, 11 aa, Artificial Sequence
  Description of Artificial Sequence: Synthetic construct
AAWDDSLSAVV

SEQ ID NO: 256 - protein, 13 aa, Artificial Sequence
  Description of Artificial Sequence: Synthetic construct
SGSNSNIGTNYVS

SEQ ID NO: 257 - protein, 7 aa, Artificial Sequence
  Description of Artificial Sequence: Synthetic construct
RSSRRPS

SEQ ID NO: 258 - protein, 12 aa, Artificial Sequence
  Description of Artificial Sequence: Synthetic construct
AAWDGSLSGHWV

SEQ ID NO: 259 - protein, 11 aa, Artificial Sequence
  Description of Artificial Sequence: Synthetic construct
RASQSIDTYLN

SEQ ID NO: 260 - protein, 7 aa, Artificial Sequence
  Description of Artificial Sequence: Synthetic construct
SASSLHS

SEQ ID NO: 261 - protein, 10 aa, Artificial Sequence
  Description of Artificial Sequence: Synthetic construct
QQSYSTTAWT

SEQ ID NO: 262 - protein, 11 aa, Artificial Sequence
  Description of Artificial Sequence: Synthetic construct
RASQSIGQSLN

SEQ ID NO: 263 - protein, 7 aa, Artificial Sequence
  Description of Artificial Sequence: Synthetic construct
GASSLQS

SEQ ID NO: 264 - protein, 9 aa, Artificial Sequence
  Description of Artificial Sequence: Synthetic construct
QQSYSTPIT

SEQ ID NO: 265 - skipped

SEQ ID NO: 266 - protein, 21 aa, Homo sapiens
MALPVTALLLPLALLLHAARP

SEQ ID NO: 267 - protein, 16 aa, Homo sapiens
GLAVSTISSFFPPGYQ

SEQ ID NO: 268 - protein, 45 aa, Homo sapiens
TTTPAPRPPTPAPTIASQPLSLRPEACRPAAGGAVHTRGLDFACD

SEQ ID NO: 269 - protein, 231 aa, Homo sapiens
EPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 24 aa, Homo sapiens
IYIWAPLAGTCGVLLLSLVITLYC

SEQ ID NO: 271 - protein, 42 aa, Homo sapiens
KRGRKKLLYIFKQPFMRPVQTTQEEDGCSCRFPEEEEGGCEL

SEQ ID NO: 272 - protein, 112 aa, Homo sapiens
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 273 - protein, 52 aa, Homo sapiens
FFIPLLVVILFAVDTGLFISTQQQVTFLLKIKRTRKGFRLLNPHPKPNPKNN

SEQ ID NO: 274 - protein, 215 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPE

SEQ ID NO: 275 - protein, 42 aa, Homo sapiens; identical to SEQ ID NO: 271

SEQ ID NO: 276 - protein, 41 aa, Homo sapiens
RSKRSRGGHSDYMNMTPRRPGPTRKHYQPYAPPRDFAAYRS

SEQ ID NO: 277 - protein, 18 aa, Homo sapiens
MIPAVVLLLLLLVEQAAA

SEQ ID NO: 278 - protein, 43 aa, Homo sapiens
LGEPQLCYILDAILFLYGIVLTLLYCRLKIQVRKAAITSYEKS

SEQ ID NO: 279 - protein, 22 aa, Homo sapiens
GSGATNFSLLKQAGDVEENPGP

SEQ ID NO: 280 - protein, 21 aa, Homo sapiens
GSGEGRGSLLTCGDVEENPGP

SEQ ID NO: 281 - protein, 530 aa, Artificial Sequence
  Description of Artificial Sequence: Synthetic construct
LTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGRPALE

SEQ ID NO: 282 - protein, 530 aa, Artificial Sequence
  Description of Artificial Sequence: Synthetic construct
LTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNNGGKQALETVQRLLPVLCQAHGLTPQQVVAIASNGGGRPALE

SEQ ID NO: 283 - protein, 530 aa, Artificial Sequence
  Description of Artificial Sequence: Synthetic construct
LTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALE

SEQ ID NO: 284 - protein, 539 aa, Artificial Sequence
  Description of Artificial Sequence: Synthetic construct
NPQRSTVWYLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGRPALE

SEQ ID NO: 285 - protein, 530 aa, Artificial Sequence
  Description of Artificial Sequence: Synthetic construct
LTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALE

SEQ ID NO: 286 - protein, 530 aa, Artificial Sequence
  Description of Artificial Sequence: Synthetic construct
LTPQQVVAIASNNGGKQALETVQRLLPVLCQAHGLTPQQVVAIASNNGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGRPALE

SEQ ID NO: 287 - protein, 530 aa, Artificial Sequence
  Description of Artificial Sequence: Synthetic construct
LTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNGGGRPALE

SEQ ID NO: 288 - protein, 530 aa, Artificial Sequence
  Description of Artificial Sequence: Synthetic construct
LTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASNIGGKQALETVQALLPVLCQAHGLTPEQVVAIASHDGGKQALETVQRLLPVLCQAHGLTPQQVVAIASNGGGRPALE

SEQ ID NO: 289 - protein, 530 aa, Artificial Sequence
  Description of Artificial Sequence: Synthetic construct
LTPQQVVAIASNNGGKQALETVQRLLPVLCQAHGLTPQQVVAIASNNGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPQQVVAIASNGGGRPALE

SEQ ID NO: 290 - protein, 530 aa, Artificial Sequence
  Description of Artificial Sequence: Synthetic construct
LTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASNIGGKQALETVQALLPVLCQAHGLTPQQVVAIASNGGGKQALETVQRLLPVLCQAHGLTPQQVVAIASNGGGKQALETVQRLLPVLCQAHGLTPEQVVAIASHDGGKQALETVQRLLPVLCQAHGLTPEQVVAIASNIGGKQALETVQALLPVLCQAHGLTPQQVVAIASNNGGKQALETVQRLLPVLCQAHGLTPEQVVAIASHDGGKQALETVQRLLPVLCQAHGLTPQQVVAIASNGGGKQALETVQRLLPVLCQAHGLTPQQVVAIASNNGGKQALETVQRLLPVLCQAHGLTPEQVVAIASHDGGKQALETVQRLLPVLCQAHGLTPQQVVAIASNGGGRPALE

SEQ ID NO: 291 - protein, 136 aa, Artificial Sequence
  Description of Artificial Sequence: Synthetic construct
CPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 292 - protein, 157 aa, Artificial Sequence
  Description of Artificial Sequence: Synthetic construct
MGTSLLCWMALCLLGADHADACPYSNPSLCSGGGGSELPTQGTFSNVSTNVSPAKPTTTACPYSNPSLCSGGGGSPAPRPPTPAPTIASQPLSLRPEACRPAAGGAVHTRGLDFACDIYIWAPLAGTCGVLLLSLVITLYCNHRNRRRVCKCPRPVV

SEQ ID NO: 293 - protein, 9 aa, Artificial Sequence
  Description of Artificial Sequence: Synthetic construct
CPYSNPSLC

SEQ ID NO: 294 - protein, 37 aa, Artificial Sequence
  Description of Artificial Sequence: Synthetic construct
GSGGGGSCPYSNPSLCSGGGGSCPYSNPSLCSGGGGS

SEQ ID NO: 295 - protein, 24 aa, Artificial Sequence
  Description of Artificial Sequence: Synthetic peptide
ELPTQGTFSNVSTNVSPAKPTTTA

SEQ ID NO: 296 - protein, 15 aa, Artificial Sequence
  Description of Artificial Sequence: Synthetic construct
GGGGSGGGGSGGGGS

SEQ ID NO: 297 - DNA, 369 bp, Artificial Sequence
  Description of Artificial Sequence: Synthetic construct
caggtcaccttgaaggagtctggtcctgtgctggtgaaacccacagagaccctcacgctgacctgcaccgtctctgggttctcactcagtaatgctagaatgggtgtgacctggatccgtcagcccccagggaaggccctggagtggcttgcacacattttttcgaatgacgaaaaatcctacagtacatctctgaagagcaggctcaccatctccaaggacacttccaaaacccaggtggtccttaccatgaccaacatggaccctgtggacacagccacatattactgtgcacggatacgagattactatgacattagtagttattatgactactggggccagggaaccctggtcagcgtctcctca

SEQ ID NO: 298 - DNA, 321 bp, Artificial Sequence
  Description of Artificial Sequence: Synthetic construct
gacatccagatgacccagtctccatctgccatgtctgcatctgtaggagacagagtcaccatcacttgtcgggcgagtcaggacattagcaattatttagcctggtttcagcagaaaccagggaaagtccctaagcgcctgatctatgctgcatccagtttgcaaagtggggtcccatcaaggttcagcggcagtggatcggggacagaattcactctcacaatcagcagcctgctgcctgaagattttgcaacttattactgtctacagcttaatagtttcccgttcacttttggcggagggaccaaggtggagatcaac

SEQ ID NO: 299 - DNA, 372 bp, Artificial Sequence
  Description of Artificial Sequence: Synthetic construct
gaggtgcagctggtggagtctgggggaggcttggtccagcctggggggtccctgagactctcctgtgtagcctctggattcacctttagtagttattggatgagctgggtccgccaggctccagggaaggggctggagtgggtggccagcataaagcaagatggaagtgagaaatactatgtggactctgtgaagggccgattcaccatctccagagacaacgccaagaactcagtgtatctgcaaatgaacagcctgagagccgaggacacgggtgtgtattactgtgcgagagaaggagtcaactggggatggagactctactggcacttcgatctctggggccgtggaaccctggtcactgtctcctca

SEQ ID NO: 300 - DNA, 336 bp, Artificial Sequence
  Description of Artificial Sequence: Synthetic construct
gacatcgtgatgacccagtctccagactccctggctgtgtctctgggcgagagggccaccatcaactgcaagtccagccagagtgttttatacagctacaacaataagaactacgtagcttggtaccagcagaaaccaggacaacctcctaacctactcattttctgggcatctacccgggaatccggggtccctgaccgattcagtggcagcgggtctgggacagatttcactctcaccatcagcagcctgcaggctgaagatgtggcagtttactactgtcagcaatattatagtacgctcactttcggcggagggaccaaggtggagatcaaa

SEQ ID NO: 301 - DNA, 357 bp, Artificial Sequence
  Description of Artificial Sequence: Synthetic construct
gaggtgcagctggtggagtctgggggaggcttggtacagcctggggggtccctgagactctcctgtgcagtctctggattcaccttcagtaaccataacatacactgggtccgccaggctccagggaaggggctggagtggatttcatacattagtcgaagtagtagtaccatatattacgcagactctgtgaagggccgattcacaatctccagagacaatgccaagaactcactgtatctgcaaatgaacagcctgagagacgaagacacggctgtgtattactgtgcgagagatcacgctcagtggtacggtatggacgtttggggccaagggaccacggtcaccgtctcctca

SEQ ID NO: 302 - DNA, 321 bp, Artificial Sequence
  Description of Artificial Sequence: Synthetic construct
gacatccagatgacccagtctccatcttccgtgtctgcatcggtaggagacagagtcaccatcacttgtcgggcgagtcagggtattagcagctggttagcctggtatcagcagaaaccagggaaagcccctaaggtcctgatctatgctgcatccagtttgcaaagtggggtcccatcaaggttcagcggcagtggatctgggacagatttcactctcaccatcagcagcctgcagcctgaagattttgcaacttactattgtcaacaggctttcagtttcccattcactttcggccctgggaccaaagtggatatcaaa

SEQ ID NO: 303 - DNA, 366 bp, Artificial Sequence
  Description of Artificial Sequence: Synthetic construct
gaagtgcagcttgtccagagcggagccgaagtgaagaagcctggcgagagcctgaagatcagctgcaagggctccggatatcgcttcacaagttactggatagggtgggtgcgccagatgcctggtaagggactggaatggatgggctctatatatcctgatgattccgacacacgttatagcccaagctttcagggccaggtcacaatcagcgctgacaagagcatcagcaccgcctaccttcagtggtcgtctctgaaggccagcgacaccgcaatgtactactgcgcctctagcacagttgactacccgggatacagttacttcgactactggggccaaggtacactggtcaccgtcagcagc

SEQ ID NO: 304 - DNA, 336 bp, Artificial Sequence
  Description of Artificial Sequence: Synthetic construct
gagctccagagcgtgctgacccagcctcctagcgcaagcggcacccctggacagcgtgtgacaattagctgtagcggaagtcgtagcaatatcggatcaaactatgtgtattggtatcagcaattgcccggtacagcacccaaattgctcatatatagaaataatcagagacctagcggagtgcctgatcgttttagcggtagcaaaagcggcaccagcgcatcactggcaatttcaggcctgcgtagcgaagatgaggcggattattactgtgcgagttgggatggttcgctgagtgctgttgtgttcggcaccggtacaaaactgaccgttctg

SEQ ID NO: 305 - DNA, 378 bp, Artificial Sequence
  Description of Artificial Sequence: Synthetic construct
gaagtgcagcttgtccagagcggagccgaagtgaagaagcctggcgagagcctgaagatcagctgcaagggctccggatacacctttccttcatcatggataggttgggtgcgccagatgcctggtaagggactggaatggatgggcatcatataccctgatactagccatacccgttacagcccaagctttcagggccaggtcacaatcagcgctgacaagagcatcagcaccgcctaccttcagtggtcgtctctgaaggccagcgacaccgcaatgtactactgtgcccgtgcgagctatttcgatcgtggaacagggtatagttcttggtggatggatgtgtggggccaaggtacactggtcaccgtcagcagc

SEQ ID NO: 306 - DNA, 330 bp, Artificial Sequence
  Description of Artificial Sequence: Synthetic construct
gagctcgatattcagatgacccagagccctagcagcctgagcgcaagcgtgggcgatagagtgaccattacctgtagggcctcacaatccatatacgactatttgcactggtatcagcagaaacccgggaaagcacccaaactgctgatttacgatgcttccaacctacagagtggcgttccttcacgttttagcggtagcggttcaggcaccgatttcaccctgaccattagcagccttcagcccgaagatttcgctacgtattattgccagcaatcatacaccacgccgttgtttacattcggccagggtaccaaagtggaaatcaaa

SEQ ID NO: 307 - DNA, 366 bp, Artificial Sequence
  Description of Artificial Sequence: Synthetic construct
gaagtgcagcttgtccagagcggagccgaagtgaagaagcctggcgagagcctgaagatcagctgcaagggctccggatacggattcacaagttattggataggttgggtgcgccagatgcctggtaagggactggaatggatgggtatcattcatcccgatgatagcgacaccaaatacagcccaagctttcagggccaggtcacaatcagcgctgacaagagcatcagcaccgcctaccttcagtggtcgtctctgaaggccagcgacaccgcaatgtactactgtgcctctagctatttgcgtggcttgtggggaggctattttgactattggggccaaggtacactggtcaccgtcagcagc

SEQ ID NO: 308 - DNA, 339 bp, Artificial Sequence
  Description of Artificial Sequence: Synthetic construct
gagctccagagcgtgctgacccagcctcctagcgcaagcggcacccctggacagcgtgtgacaattagctgtagcggatcaagctcaaacattggctcaaattatgtgaattggtatcagcaattgcccggtacagcacccaaactgctcatttatggagattatcaacgacctagcggagtgcctgatcgttttagcggtagcaaaagcggcaccagcgcatcactggcaatttcaggcctgcgtagcgaagatgaggcggattattactgtgctacccgcgacgattcgttatctgggtctgtcgtttttggcaccggtacaaaactgaccgtgctg

SEQ ID NO: 309 - DNA, 366 bp, Artificial Sequence
  Description of Artificial Sequence: Synthetic construct
gaagtgcagcttgtccagagcggagccgaagtgaagaagcctggcgagagcctgaagatcagctgcaagggctccggatacagttttgcctcatactggatcggttgggtgcgccagatgcctggtaagggactggaatggatgggcgtaatttaccccggaactagcgagacacgttacagcccaagctttcagggccaggtcacaatcagcgctgacaagagcatcagcaccgcctaccttcagtggtcgtctctgaaggccagcgacaccgcaatgtactactgcgctaaagggttgagtgcgagtgcaagtggatattctttccaatattggggccaaggtacactggtcaccgtcagcagc

SEQ ID NO: 310 - DNA, 330 bp, Artificial Sequence
  Description of Artificial Sequence: Synthetic construct
gagctcgatattcagatgacccagagccctagcagcctgagcgcaagcgtgggcgatagagtgaccattacctgtagggcctcacaaagcatcgacacatatttaaactggtatcagcagaaacccgggaaagcacccaaactgctgatttattcagctagtagcctacacagtggcgttccttcacgttttagcggtagcggttcaggcaccgatttcaccctgaccattagcagccttcagcccgaagatttcgctacgtattattgccaacaatcatacagcacaactgcttggacattcggccagggtaccaaagtggaaatcaaa

SEQ ID NO: 311 - protein, 494 aa, Artificial Sequence
  Description of Artificial Sequence: Synthetic construct
MALPVTALLLPLALLLHAARPQVQLVQSGAEVKKPGSSVKVSCKASGGTFSSYGFSWVRQAPGQGLEWMGGIIPIFGSANYAQKFQGRVTITADKSTSTVYMELISLRSEDTAVYYCARGGSSSPFAYWGQGTLVTVSSGGGGSGGGGSGGGGSGGGGSDIVMTQNPLSSPVTLGQPASISCRSSQSLVHSDGNTYLSWLQQRPGQSPRLLIYKISNRFSGVPDRFSGSGAGTDFTLKISRVEAEDVGVYYCMQATQFPLTIGGGSKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - protein, 494 aa, Artificial Sequence
  Description of Artificial Sequence: Synthetic construct
MALPVTALLLPLALLLHAARPQVQLVQSGAEVKKPGSSVKVSCKASGGTFSSYGFSWVRQAPGQGLEWMGGIIPIFGTANYAQKFQGRVTITADKSTSTVFMELISLRSEYTAVYYCARGGSSSPFAYWGQGTLVTVSSGGGGSGGGGSGGGGSGGGGSDIVMTQTPLSSPVTLGQPASISCRSSQSLVHSDGNTYLSWLQQRPGQSPRLLIYKISNRFSGVPDRFSGSGAGTDFTLKISRVEAEDVGVYYCMQATQFPLTIGGGSKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - protein, 483 aa, Artificial Sequence
  Description of Artificial Sequence: Synthetic construct
MALPVTALLLPLALLLHAARPQVQLQESGPGLVKPSETLSLTCTVSGGSISSYYWNWIRQPPGKGLEWIGYIYYSGSTNYNPSLKSRVTISVDTSKNQFSLKLRSVTAADTAVYYCARDIRTWGQGTLVTVSSGGGGSGGGGSGGGGSGGGGSDIQMTQSPSSLSASVGDRVTITCRASQGISNYLAWFQQKPGKAPKSLIYAASSLQSGVPSKFSGSGSGTDFTLTISSLQPEDFATYYCQQYNSYPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - protein, 493 aa, Artificial Sequence
  Description of Artificial Sequence: Synthetic construct
MALPVTALLLPLALLLHAARPEVQLVESGGGLVQPGGSLRLSCAASGFTFRNSWMSWVRQAPGKGLEWVANIKRDGSEKYYVDSVKGRFTISRDNAKNSLYLQMNSLRAEDTAVYYCARDQTGSFDYWGQGTLVTVSSGGGGSGGGGSGGGGSGGGGSDVVMTQSPLSLPVTLGQPASISCRSSQSLVYSDENTYLNWFQQRPGQSLRRLIYQVSNRDSGVPDRFSGSGSGTDFTLKISRVEAEDVGVYFCMQGTYWPPTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - protein, 485 aa, Artificial Sequence
  Description of Artificial Sequence: Synthetic construct
MALPVTALLLPLALLLHAARPQVQLRGSGPGLVKPSETLSLTCTVSDDSISVYYWSWIRQPAGKGLEWIGRVYSSGNINYNPSLESRVTMSVDTSKSRFSLNLSSVTAADTAVYYCARGLDAFDIWGQGTMVTVSSGGGGSGGGGSGGGGSGGGGSEIVMTQSPATLSMSLGERATLSCRASQSVSSSLAWYQQKPGQAPRLLIYGASTRATGIPARFGGSGSGTEFTLTISSLQSEDFAVYYCQQYINWPHFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 316 - protein, 486 aa, Artificial Sequence
  Description of Artificial Sequence: Synthetic construct
MALPVTALLLPLALLLHAARPEVQLLESGGGLVQPGESLRLSCEVSGFTFTSYAMSWVRQVPGKGLEWVSIISGVAFTTYYADSVKGRFTISRDHSKNTLYLQMNGLRAEDTAVYYCVKVDGEVYWGQGTLVTVSSGGGGSGGGGSGGGGSGGGGSDIQMTQSPSSLSASVGDRVTITCQASQDISNYLNWYQQKPGKAPKILIYGASNLETGVPSRFSGSGSGTDFTFAISSLQPEDVATYYCQQYDNFPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 317 - protein, 489 aa, Artificial Sequence
  Description of Artificial Sequence: Synthetic construct
MALPVTALLLPLALLLHAARPQVQLVQSGAEVKKPGSSVKVSCEASGGTFITYAISWVRQAPGQGLEWMGGIIPFFGTANYAQKFQGRVTITADKSTSTASMELRSLRSEDTAMYYCAQWELFFFDFWGQGTPVTVSSGGGGSGGGGSGGGGSGGGGSEIVMTQSPDTLSVSPGERAILSCRASQSVSSNLAWYQQKPGQAPRLLIYSASTRASGIPARFSGSGSGTEFTLSISSLQSEDFAVYYCQQYDNWPPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 318 - protein, 492 aa, Artificial Sequence
  Description of Artificial Sequence: Synthetic construct
MALPVTALLLPLALLLHAARPAVQLVESGGGLVQPGGSLRLSCAASGFTFTYYSMNWVRQAPGKGLEWVSHISIRSSTIYFADSAKGRFTISRDNAKNSLYLQMNSLRDEDTAVYYCARGSGWYGDYFDYWGQGTLVTVSSGGGGSGGGGSGGGGSGGGGSEIVLTQSPGTLSLSPGERATLSCRASQSVSSSYLAWYQQQPGQAPRLLIYGASSRATGIPDRFSGSGSGTDFTLTISRLEPEDFAIYYCQQYGSSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 319 - protein, 494 aa, Artificial Sequence
  Description of Artificial Sequence: Synthetic construct
MALPVTALLLPLALLLHAARPQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - protein, 490 aa, Artificial Sequence
  Description of Artificial Sequence: Synthetic construct
MALPVTALLLPLALLLHAARPEVQLVESGGGLVQPGGSLRLSCAVSGFTFSNHNIHWVRQAPGKGLEWISYISRSSSTIYYADSVKGRFTISRDNAKNSLYLQMNSLRDEDTAVYYCARDHAQWYGMDVWGQGTTVTVSSGGGGSGGGGSGGGGSGGGGSDIQMTQSPSSVSASVGDRVTITCRASQGISSWLAWYQQKPGKAPKVLIYAASSLQSGVPSRFSGSGSGTDFTLTISSLQPEDFATYYCQQAFSFPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 500 aa, Artificial Sequence
  Description of Artificial Sequence: Synthetic construct
MALPVTALLLPLALLLHAARPEVQLVESGGGLVQPGGSLRLSCVASGFTFSSYWMSWVRQAPGKGLEWVASIKQDGSEKYYVDSVKGRFTISRDNAKNSVYLQMNSLRAEDTGVYYCAREGVNWGWRLYWHFDLWGRGTLVTVSSGGGGSGGGGSGGGGSGGGGSDIVMTQSPDSLAVSLGERATINCKSSQSVLYSYNNKNYVAWYQQKPGQPPNLLIFWASTRESGVPDRFSGSGSGTDFTLTISSLQAEDVAVYYCQQYYSTLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 322 - protein, 492 aa, Artificial Sequence
  Description of Artificial Sequence: Synthetic construct
MALPVTALLLPLALLLHAARPEVQVVESGGGLVQPGGSLRLSCAASGFTFSSYSMNWVRQAPGKGLEWVSHSSISRGNIYFADSVKGRFTISRDNAKNSLYLQMNSLRDEDTAVYYCARGSGWYGDYFDYWGQGTLVTVSSGGGGSGGGGSGGGGSGGGGSEIVLTQSPGTLSLSPGERVTLSCRASQSVSSSYLAWYQQKPGQAPRLLIYDASSRATGIPDRFSGSGSGTDFTLTISRLEPEDFAVYYCQQYGSSPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - protein, 496 aa, Artificial Sequence
  Description of Artificial Sequence: Synthetic construct
MALPVTALLLPLALLLHAARPEVQLLESGGGLVQPGGSLRLSCAASGFAFSNYAMSWVRQAPGKGLEWVSAIRGGGGSTYYADSVKGRFTISRDNSKNTLYLQMNSLRAEDTAVYYCARDFISGTWYPDYWGQGTLVTVSSGGGGSGGGGSGGGGSGGGGSELQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGVVFGGGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - protein, 498 aa, Artificial Sequence
  Description of Artificial Sequence: Synthetic construct
MALPVTALLLPLALLLHAARPEVQLVQSGAEVKKPGESLKISCKGSGYRFTSYWIGWVRQMPGKGLEWMGSIYPDDSDTRYSPSFQGQVTISADKSISTAYLQWSSLKASDTAMYYCASSTVDYPGYSYFDYWGQGTLVTVSSGGGGSGGGGSGGGGSGGGGSELQSVLTQPPSASGTPGQRVTISCSGSRSNIGSNYVYWYQQLPGTAPKLLIYRNNQRPSGVPDRFSGSKSGTSASLAISGLRSEDEADYYCASWDGSLSAVVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 499 aa, Artificial Sequence
  Description of Artificial Sequence: Synthetic construct
MALPVTALLLPLALLLHAARPEVQLVQSGAEVKKPGESLKISCKGSGYTFTNYWIAWVRQMPGKGLEWMGIIYPDGSDTRYSPSFQGQVTISADKSISTAYLQWSSLKASDTAMYYCARDITSWYYGEPAFDIWGQGTLVTVSSGGGGSGGGGSGGGGSGGGGSELQSVLTQPPSASGTPGQRVTISCSGSSSNIGSNYVYWYQQLPGTAPKLLIYRNNQRPSGVPDRFSGSKSGTSASLAISGLRSEDEADYYCATWDDSLGSPVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 326 - protein, 496 aa, Artificial Sequence
  Description of Artificial Sequence: Synthetic construct
MALPVTALLLPLALLLHAARPEVQLVQSGAEVKKPGESLKISCKGSGYSFTSSWIGWVRQMPGKGLEWMGIIYPGDSDTRYSPSFQGQVTISADKSISTAYLQWSSLKASDTAMYYCAKGLSQAMTGFGFDYWGQGTLVTVSSGGGGSGGGGSGGGGSGGGGSELDIQMTQSPSSLSASVGDRVTITCRASQSISRYLNWYQQKPGKAPKLLIYAASILQTGVPSRFSGSGSGTDFTLTISSLQPEDFATYYCQQSYSTTMWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 327 - protein, 499 aa, Artificial Sequence
  Description of Artificial Sequence: Synthetic construct
MALPVTALLLPLALLLHAARPEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 328 - protein, 500 aa, Artificial Sequence
  Description of Artificial Sequence: Synthetic construct
MALPVTALLLPLALLLHAARPEVQLVQSGAEVKKPGESLKISCKGSGYTFPSSWIGWVRQMPGKGLEWMGIIYPDTSHTRYSPSFQGQVTISADKSISTAYLQWSSLKASDTAMYYCARASYFDRGTGYSSWWMDVWGQGTLVTVSSGGGGSGGGGSGGGGSGGGGSELDIQMTQSPSSLSASVGDRVTITCRASQSIYDYLHWYQQKPGKAPKLLIYDASNLQSGVPSRFSGSGSGTDFTLTISSLQPEDFATYYCQQSYTTPLFTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - protein, 497 aa, Artificial Sequence
  Description of Artificial Sequence: Synthetic construct
MALPVTALLLPLALLLHAARPEVQLLESGGGLVQPGGSLRLSCAASGFTFSQYSMSWVRQAPGKGLEWVSAISGGGVSTYYADSVKGRFTISRDNSKNTLYLQMNSLRAEDTAVYYCASDISDSGGSHWYFDYWGQGTLVTVSSGGGGSGGGGSGGGGSGGGGSELDIQMTQSPSSLSASVGDRVTITCRASQYIGRYLNWYQQKRGKAPKLLIHGATSLASGVPSRFSGSGSGTDFTLTISSLQPEDFATYYCQQSYSTTSPTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 330 - protein, 497 aa, Artificial Sequence
  Description of Artificial Sequence: Synthetic construct
MALPVTALLLPLALLLHAARPEVQLLESGGGLVQPGGSLRLSCAASGFTFSSYAMSWVRQAPGKGLEWVSTISGTGGTTYYADSVKGRFTISRDNSKNTLYLQMNSLRAEDTAVYYCAKVRAGIDPTASDVWGQGTLVTVSSGGGGSGGGGSGGGGSGGGGSELQSVLTQPPSASGTPGQRVTISCSGSTSNIGRNYVYWYQQLPGTAPKLLIYRTNQRPSGVPDRFSGSKSGTSASLAISGLRSEDEADYYCAAWDDSLSGRVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 500 aa, Artificial Sequence
  Description of Artificial Sequence: Synthetic construct
MALPVTALLLPLALLLHAARPEVQLLESGGGLVQPGGSLRLSCAASGFTFNNFAMSWVRQAPGKGLEWVSGISGSGDNTYYADSVKGRFTISRDNSKNTLYLQMNSLRAEDTAVYYCAKDRDIGLGWYSYYLDVWGQGTLVTVSSGGGGSGGGGSGGGGSGGGGSELQSVLTQPPSASGTPGQRVTISCSGSSSNIGSNYVYWYQQLPGTAPKPLIYMNNQRPSGVPDRFSGSKSGTSASLAISGLRSEDEADYYCAAWDDSLSAVVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - protein, 496 aa, Artificial Sequence
  Description of Artificial Sequence: Synthetic construct
MALPVTALLLPLALLLHAARPQVQLVQSGAEVKKPGSSVKVSCKASGGTFSSYAISWVRQAPGQGLEWMGEIIPIFGTASYAQKFQGRVTITADESTSTAYMELSSLRSEDTAVYYCARAGWDDSWFDYWGQGTLVTVSSGGGGSGGGGSGGGGSGGGGSELQSVLTQPPSASGTPGQRVTISCSGSNSNIGTNYVSWYQQLPGTAPKLLIYRSSRRPSGVPDRFSGSKSGTSASLAISGLRSEDEADYYCAAWDGSLSGHWVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 496 aa, Artificial Sequence
  Description of Artificial Sequence: Synthetic construct
MALPVTALLLPLALLLHAARPEVQLVQSGAEVKKPGESLKISCKGSGYSFASYWIGWVRQMPGKGLEWMGVIYPGTSETRYSPSFQGQVTISADKSISTAYLQWSSLKASDTAMYYCAKGLSASASGYSFQYWGQGTLVTVSSGGGGSGGGGSGGGGSGGGGSELDIQMTQSPSSLSASVGDRVTITCRASQSIDTYLNWYQQKPGKAPKLLIYSASSLHSGVPSRFSGSGSGTDFTLTISSLQPEDFATYYCQQSYSTTAWTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 497 aa, Artificial Sequence
  Description of Artificial Sequence: Synthetic construct
MALPVTALLLPLALLLHAARPEVQLVQSGAEVKKPGESLKISCKGSGYSFTDYWIGWVRQMPGKGLEWMGMISPGGSTTIYRPSFQGQVTISADKSISTAYLQWSSLKASDTAMYYCAREMYTGGYGGSWYFDYWGQGTLVTVSSGGGGSGGGGSGGGGSGGGGSELDIQMTQSPSSLSASVGDRVTITCRASQSIGQSLNWYQQKPGKAPKLLIYGASSLQSGVPSRFSGSGSGTDFTLTISSLQPEDFATYYCQQSYSTPITFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 336 - DNA, 933 bp, Artificial Sequence
  Description of Artificial Sequence: Synthetic construct
  modified_base (793)..(793): a, c, t, or g
  modified_base (797)..(797): a, c, t, or g
atggctctcccggtcacggccctgctgctgcctctggcgctgctcctgcacgcggcgcgcccgcaggtcaccttgaaggagtctggtcctgtgctggtgaaacccacagagaccctcacgctgacctgcaccgtctctgggttctcactcagtaatgctagaatgggtgtgacctggatccgtcagcccccagggaaggccctggagtggcttgcacacattttttcgaatgacgaaaaatcctacagtacatctctgaagagcaggctcaccatctccaaggacacttccaaaacccaggtggtccttaccatgaccaacatggaccctgtggacacagccacatattactgtgcacggatacgagattactatgacattagtagttattatgactactggggccagggaaccctggtcagcgtctcctcaggcggaggcggttctggcggaggtggcagcggtggtggcggaagtgggggtggcggctccgacatccagatgacccagtctccatctgccatgtctgcatctgtaggagacagagtcaccatcacttgtcgggcgagtcaggacattagcaattatttagcctggtttcagcagaaaccagggaaagtccctaagcgcctgatctatgctgcatccagtttgcaaagtggggtcccatcaaggttcagcggcagtggatcggggacagaattcactctcacaatcagcagcctgctgcctgaagattttgcaacttattactgtctacagcttaatagtttcccgttcacttttggcgganggancaaggtggagatcaacactaccacaccagcacctcgaccaccaactccagcaccaaccattgcatcacagccactgagcctgcgaccagaggcctgtagacctgctgcaggaggagctgtgcatacccgaggactg

SEQ ID NO: 337 - DNA, 948 bp, Artificial Sequence
  Description of Artificial Sequence: Synthetic construct
atggctctcccggtcacggccctgctgctgcctctggcgctgctcctgcacgcggcgcgcccggaagtgcagcttgtccagagcggagccgaagtgaagaagcctggcgagagcctgaagatcagctgcaagggctccggatacggattcacaagttattggataggttgggtgcgccagatgcctggtaagggactggaatggatgggtatcattcatcccgatgatagcgacaccaaatacagcccaagctttcagggccaggtcacaatcagcgctgacaagagcatcagcaccgcctaccttcagtggtcgtctctgaaggccagcgacaccgcaatgtactactgtgcctctagctatttgcgtggcttgtggggaggctattttgactattggggccaaggtacactggtcaccgtcagcagcggcggaggcggttctggcggaggtggcagcggtggtggcggaagtgggggtggcggctccgagctccagagcgtgctgacccagcctcctagcgcaagcggcacccctggacagcgtgtgacaattagctgtagcggatcaagctcaaacattggctcaaattatgtgaattggtatcagcaattgcccggtacagcacccaaactgctcatttatggagattatcaacgacctagcggagtgcctgatcgttttagcggtagcaaaagcggcaccagcgcatcactggcaatttcaggcctgcgtagcgaagatgaggcggattattactgtgctacccgcgacgattcgttatctgggtctgtcgtttttggcaccggtacaaaactgaccgtgctgactaccacaccagcacctcgaccaccaactccagcaccaaccattgcatcacagccactgagcctgcgaccagaggcctgtagacctgctgcaggaggagctgtgcatacccgaggactg

SEQ ID NO: 338 - protein, 107 aa, Artificial Sequence
  Description of Artificial Sequence: Synthetic construct
DIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIK

SEQ ID NO: 339 - protein, 118 aa, Artificial Sequence
  Description of Artificial Sequence: Synthetic construct
QVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSS

SEQ ID NO: 340 - protein, 107 aa, Artificial Sequence
  Description of Artificial Sequence: Synthetic construct
DIQMTQSPSTLSASVGDRVTITCRASQSISSWLAWYQQKPGKAPKVLIYKASSLESGVPSRFSGSGSGTEFTLTINSLQPDDFATYYCQQYKSFSLTFGQGTKLEIK

SEQ ID NO: 341 - protein, 113 aa, Artificial Sequence
  Description of Artificial Sequence: Synthetic construct
EVQLVESGGGLIQPGGSLRLSCAASGFTVSSNYMTWVRQAPGKGLEWVSVIYSGGSTYYADSVKGRFTISRDNSKNTLYLQMNSLRAEDTAVYYCARNWGDYWGQGTLVTVSS

SEQ ID NO: 342 - protein, 107 aa, Artificial Sequence
  Description of Artificial Sequence: Synthetic construct
DIQMTQSPSTLSASVGDRVTITCRASQSISSWLAWYQQKPGKAPKVLIYKASTLESGVPSRFSGSGSGTEFTLTISSLQPDDFATYYCQQYNSYSYTFGHGTKLEIK

SEQ ID NO: 343 - protein, 118 aa, Artificial Sequence
  Description of Artificial Sequence: Synthetic construct
QVQLQESGPGLVKPSGTLSLTCTVSGGSIDYYFWNWFRQSPVKGLEWIGHVYDIGNTKYNPSLKSRVTISIDTSENQFSLKLNSVTAADTAVYYCARGEGALDAFDIWGQGTMVTVSS

SEQ ID NO: 344 - protein, 107 aa, Artificial Sequence
  Description of Artificial Sequence: Synthetic construct
DIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIK

SEQ ID NO: 345 - protein, 118 aa, Artificial Sequence
  Description of Artificial Sequence: Synthetic construct
QVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSS

SEQ ID NO: 346 - protein, 107 aa, Artificial Sequence
  Description of Artificial Sequence: Synthetic construct
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPFTFGPGTKVDIK

SEQ ID NO: 347 - protein, 120 aa, Artificial Sequence
  Description of Artificial Sequence: Synthetic construct
QVQLVESGGGVVQPGRSLRLSCVASGFTFSDYGIHWVRQAPGMGQEWVAVIWYDGSIKKYSDSVKGRFIISRDNSENTVYLQMNSLRGEDTAIYYCARDEVGTFGAFDFWGQGTKVTVSS

SEQ ID NO: 348 - protein, 107 aa, Artificial Sequence
  Description of Artificial Sequence: Synthetic construct
DIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIK

SEQ ID NO: 349 - protein, 118 aa, Artificial Sequence
  Description of Artificial Sequence: Synthetic construct
QVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSS

SEQ ID NO: 350 - protein, 107 aa, Artificial Sequence
  Description of Artificial Sequence: Synthetic construct
DIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIK

SEQ ID NO: 351 - protein, 118 aa, Artificial Sequence
  Description of Artificial Sequence: Synthetic construct
QVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSS

SEQ ID NO: 352 - protein, 112 aa, Artificial Sequence
  Description of Artificial Sequence: Synthetic construct
DIVMTQSPLSLPVTPGEPASISCRSSQSLLHSNGYNYLDWYLQKPGQSPQVLILLGSNRASGVPDRVSASGSGTDFTLKISRMQAEDVGIYYCMQTLQTPFTFGQGTKLEIK

SEQ ID NO: 353 - protein, 122 aa, Artificial Sequence
  Description of Artificial Sequence: Synthetic construct
QVQLVQSGAEVKKPGASVKVSCKASGYTFTGYYLHWVRQAPGQGLEWMGWINPNSGGTNYAQKFQGRVTMTRDTSITTAYMELSRLRIDDTAVYYCARDRGVTMIVDGMDDWGQGTTVTVSS

SEQ ID NO: 354 - protein, 107 aa, Artificial Sequence
  Description of Artificial Sequence: Synthetic construct
DIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDIN

SEQ ID NO: 355 - protein, 120 aa, Artificial Sequence
  Description of Artificial Sequence: Synthetic construct
EVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSS

SEQ ID NO: 356 - protein, 107 aa, Artificial Sequence
  Description of Artificial Sequence: Synthetic construct
DIQMTQSPSSLSASVGDRVTITCRASQGISNYLAWYQQKPGKVPKLLIYAASTLHSGVPSRFSGSGSGTDFTLTISSLQPEDVATYYCQKYNSAPRTFGQGTKVEIK

SEQ ID NO: 357 - protein, 118 aa, Artificial Sequence
  Description of Artificial Sequence: Synthetic construct
QVQLQESGPGLVKPSQTLSLTCTVSGGSISSDGYYWSWIRQHPGKGLEWIGYMYYSGITYHNPSLKSRVTISVDTSKNQFSLRLSSVTAADTAVYYCARDFGWYFDLWGRGTLVTVSS

SEQ ID NO: 358 - protein, 107 aa, Artificial Sequence
  Description of Artificial Sequence: Synthetic construct
DIQMTQSPSSLSASVGDRVTITCRASQDISNYLAWYQQKPGKVPKLLIYAASTLHSGVPSRFSGSGSGTDFTLTISSLQPDDFAAYYCQKYNSAPRTFGQGTKVEIK

SEQ ID NO: 359 - protein, 118 aa, Artificial Sequence
  Description of Artificial Sequence: Synthetic construct
QVQLQESGPGLVKPSQTLSLTCTVSGGSISSDAYYWSWIRQHPGKGLEWIGYMYYSGITYYNPSLKSRVTISVDTSKNQFSLKLSSVTAADTAVYYCARDFGWYFDLWGRGTLVTVSS

SEQ ID NO: 360 - protein, 107 aa, Artificial Sequence
  Description of Artificial Sequence: Synthetic construct
DIQLTQSPSFLSASVGDRVSITCRASQDISSFLAWYQQKPGKAPVLLIYVASTLQSGVPSRFSGSGSGTEFTLTVSSLQPEDFATYYCQQLHVYPITFGQGTRLEIR

SEQ ID NO: 361 - protein, 120 aa, Artificial Sequence; identical to SEQ ID NO: 347
  Description of Artificial Sequence: Synthetic construct

SEQ ID NO: 362 - protein, 113 aa, Artificial Sequence
  Description of Artificial Sequence: Synthetic construct
DIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPFTFGPGTKVDIK

SEQ ID NO: 363 - protein, 122 aa, Artificial Sequence
  Description of Artificial Sequence: Synthetic construct
EVQLVESGGGLVKPGGSLRLSCAASGFTFSNAWMSWVRQAPGKGLEWVGRIKSKTGGGTTDYAAPVKGRFTISRDDSKNTLYLQMNSLKTEDTAVYYCTSLIVGAISLFDYWGQGTLVTVSS

SEQ ID NO: 364 - protein, 107 aa, Artificial Sequence
  Description of Artificial Sequence: Synthetic construct
DIQMTQSPSALSASVGDRVAITCRASQTISTWLAWYQQKPGKAPKVLIYKASNLESGVPSRFSGSGSGTEFTLTINSLQPDDFATYYCQQYQTFSHTFGQGTKLEIK

SEQ ID NO: 365 - protein, 118 aa, Artificial Sequence
  Description of Artificial Sequence: Synthetic construct
QVQLRESGPGLVKPSETLSLTCTISGGSISYYFWTWIRQPPGRGLEWIGQIYYSGNTNSNPSLKSRVTISIDTSKNQFSLKLTSVTVADTAVYYCVRAEGSLDAFDIWGQGTMVAVSS

SEQ ID NO: 366 - protein, 107 aa, Artificial Sequence
  Description of Artificial Sequence: Synthetic construct
DMQMTQSPSSLSASVGDRVTLTCRASQGISNYLAWFQLKPGKVPKLLIYAASTLQSGVPSRFSGSGSGTDFALTISSLQPEDVATYYCQKYNSAPLTFGGGTKVEIK

SEQ ID NO: 367 - protein, 122 aa, Artificial Sequence
  Description of Artificial Sequence: Synthetic construct
EVQLVESGGGLVKPGGSLRLSCVASGFTFSSYSMNWVRQFPGKGLEWVSSISTSSNYIHYADSLQGRFTISRDNAKNSLYLQMSSLRVEDTAVYYCVRDKGTTLTNWYFDLWGRGTLVTVSS

SEQ ID NO: 368 - protein, 112 aa, Artificial Sequence
  Description of Artificial Sequence: Synthetic construct
DIVMTQSPLSLPVTPGEPASISCRSSQTLVHSNGYNYLNWYLQKPGQSPQLLIYLGSNRASGVPDRFSGSGSGSDFTLKISRMEAEDVGVYYCMQAIQTPYTFGQGTNVEIK

SEQ ID NO: 369 - protein, 121 aa, Artificial Sequence
  Description of Artificial Sequence: Synthetic construct
QVQLVESGGGVVQPGRSLRLSCGASGFTFSSYGMHWVRQAPGKGLEWVAVIWYDGSNKYYADSLKGRFTISRDNSKNTLYLQMNSLRAEDTAVYYCARDGYSGSSDAFDIWGQGTMVTVSS

SEQ ID NO: 370 - protein, 107 aa, Artificial Sequence
  Description of Artificial Sequence: Synthetic construct
DIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIK

SEQ ID NO: 371 - protein, 118 aa, Artificial Sequence
  Description of Artificial Sequence: Synthetic construct
QVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSL

SEQ ID NO: 372 - protein, 107 aa, Artificial Sequence
  Description of Artificial Sequence: Synthetic construct
DIQMTQSPSSLSASVGDRIIFTCQASQDINNYLHWYQQKPGKAPKLLIYDASDWETGVPSRFSGSGSGTDFTFTISSLQPEDIATYYCQQYDHLPITFGQGTRVEIK

SEQ ID NO: 373 - protein, 123 aa, Artificial Sequence
  Description of Artificial Sequence: Synthetic construct
QVQLVQSGAEVTKPGASVKVSCKASGYIFTGYYIYWVRQAPGQGLEWMGWINPSSGGTNYAQKFQGRVTMARDTSISTAYMELSSLRSDDTAVYYCARDRKREYYYNFGMDVWGQGTTVTVST

SEQ ID NO: 374 - protein, 107 aa, Artificial Sequence
  Description of Artificial Sequence: Synthetic construct
DIQMTQSPSSLSASVGDRVILTCQASQDISNYLHWYQQKPGKAPKLLIYDASDLETGVPSRFSGSGSGADFTFTISNLQPEDFATYYCQQYDHLPITFGQGTRLEIK

SEQ ID NO: 375 - protein, 123 aa, Artificial Sequence
  Description of Artificial Sequence: Synthetic construct
QVQLVQSGAEVTKPGASVKVSCKASGYTFTSHYIYWVRQAPGQGLEWMGWINPNSGGTNYAQKFQDRVTMARDTSISTAYMELSRLRSDDTAVYYCAKDRKREYYYNFGMDVWGQGTTVTVSA

SEQ ID NO: 376 - protein, 107 aa, Artificial Sequence; identical to SEQ ID NO: 374
  Description of Artificial Sequence: Synthetic construct

SEQ ID NO: 377 - protein, 123 aa, Artificial Sequence
  Description of Artificial Sequence: Synthetic construct
QVQLVQFGVEVRKPGASVKVSCKVSGFTFTSHYIYWVRQAPGQGLEWMGWINPNSGGTKYAQKFQDRVTMARDTSISTAYMELSRLRSDDTSVYYCVKDRKREYYYNFGMDVWGQGTTVTVSS

SEQ ID NO: 378 - protein, 107 aa, Artificial Sequence
  Description of Artificial Sequence: Synthetic construct
DIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIK

SEQ ID NO: 379 - protein, 119 aa, Artificial Sequence
  Description of Artificial Sequence: Synthetic construct
EVQMLESGGGLIQPGGSLRLSCKTSGFTLSIYAIHWVRQAPGRGLEWVSSFGGRGSSTYFADSVKGRFTISRDASENSLYLHMNSLRAEDTAVYYCAKEKDWGRGFDYWGQGTLVTVSS

SEQ ID NO: 380 - protein, 112 aa, Artificial Sequence
  Description of Artificial Sequence: Synthetic construct
DIVMTQSPLSLPVTPGEPASISCRSSQSLLYSNGYNYLDWYLQKPGQSPQLLIFLNSNRASGVPDRFSGSGSGTDFTLKISRVEAEDVGVYFCMQALQTPLTFGGGTKVEIK

SEQ ID NO: 381 - protein, 122 aa, Artificial Sequence
  Description of Artificial Sequence: Synthetic construct
EVQLVESGGGLVKPGGSLRLSCAASGFTFSNYSMNWVRQAPGKGLEWVSSISSSTIYIYYADSVKGRFTISRDNAKKSLYLQMNSLRAEDTAVYYCARDIGWEVFTLGFDYWGQGTQVTVSS

SEQ ID NO: 382 - protein, 5 aa, Artificial Sequence
  Description of Artificial Sequence: Synthetic construct
YYYWT

SEQ ID NO: 383 - protein, 7 aa, Artificial Sequence
  Description of Artificial Sequence: Synthetic construct
GGSISYY

SEQ ID NO: 384 - protein, 10 aa, Artificial Sequence
  Description of Artificial Sequence: Synthetic construct
GGSISYYYWT

SEQ ID NO: 385 - protein, 16 aa, Artificial Sequence
  Description of Artificial Sequence: Synthetic construct
HIYYSGSTNYNPSLKS

SEQ ID NO: 386 - protein, 5 aa, Artificial Sequence
  Description of Artificial Sequence: Synthetic construct
YYSGS

SEQ ID NO: 387 - protein, 10 aa, Artificial Sequence
  Description of Artificial Sequence: Synthetic construct
AEGSLDAFDF

SEQ ID NO: 388 - protein, 5 aa, Artificial Sequence
  Description of Artificial Sequence: Synthetic construct
SNYMT

SEQ ID NO: 389 - protein, 7 aa, Artificial Sequence
  Description of Artificial Sequence: Synthetic construct
GFTVSSN

SEQ ID NO: 390 - protein, 10 aa, Artificial Sequence
  Description of Artificial Sequence: Synthetic construct
GFTVSSNYMT

SEQ ID NO: 391 - protein, 16 aa, Artificial Sequence
  Description of Artificial Sequence: Synthetic construct
VIYSGGSTYYADSVKG

SEQ ID NO: 392 - protein, 5 aa, Artificial Sequence
  Description of Artificial Sequence: Synthetic construct
YSGGS

SEQ ID NO: 393 - protein, 6 aa, Artificial Sequence
  Description of Artificial Sequence: Synthetic construct
NWGDYW

SEQ ID NO: 394 - protein, 5 aa, Artificial Sequence
  Description of Artificial Sequence: Synthetic construct
YYFWN

SEQ ID NO: 395 - protein, 7 aa, Artificial Sequence
  Description of Artificial Sequence: Synthetic construct
GGSIDYY

SEQ ID NO: 396 - protein, 10 aa, Artificial Sequence
  Description of Artificial Sequence: Synthetic construct
GGSIDYYFWN

SEQ ID NO: 397 - protein, 16 aa, Artificial Sequence
  Description of Artificial Sequence: Synthetic construct
HVYDIGNTKYNPSLKS

SEQ ID NO: 398 - protein, 5 aa, Artificial Sequence
  Description of Artificial Sequence: Synthetic construct
YDIGN

SEQ ID NO: 399 - protein, 10 aa, Artificial Sequence
  Description of Artificial Sequence: Synthetic construct
GEGALDAFDI

SEQ ID NO: 400 - protein, 5 aa, Artificial Sequence
  Description of Artificial Sequence: Synthetic construct
YYYWT

SEQ ID NO: 401 - protein, 7 aa, Artificial Sequence
  Description of Artificial Sequence: Synthetic construct
GGSISYY

SEQ ID NO: 402 - protein, 10 aa, Artificial Sequence
  Description of Artificial Sequence: Synthetic construct
GGSISYYYWT

SEQ ID NO: 403 - protein, 16 aa, Artificial Sequence
  Description of Artificial Sequence: Synthetic construct
HVIYSGTTNYNPSLKS

SEQ ID NO: 404 - protein, 5 aa, Artificial Sequence
  Description of Artificial Sequence: Synthetic construct
IYSGT

SEQ ID NO: 405 - protein, 10 aa, Artificial Sequence
  Description of Artificial Sequence: Synthetic construct
AEGSLDAFDL

SEQ ID NO: 406 - protein, 5 aa, Artificial Sequence
  Description of Artificial Sequence: Synthetic construct
DYGIH

SEQ ID NO: 407 - protein, 7 aa, Artificial Sequence
  Description of Artificial Sequence: Synthetic construct
GFTFSDY

SEQ ID NO: 408 - protein, 10 aa, Artificial Sequence
  Description of Artificial Sequence: Synthetic construct
GFTFSDYGIH

SEQ ID NO: 409 - protein, 17 aa, Artificial Sequence
  Description of Artificial Sequence: Synthetic construct
VIWYDGSIKKYSDSVKG

SEQ ID NO: 410 - protein, 6 aa, Artificial Sequence
  Description of Artificial Sequence: Synthetic construct
WYDGSI

SEQ ID NO: 411 - protein, 11 aa, Artificial Sequence
  Description of Artificial Sequence: Synthetic construct
DEVGTFGAFDF

SEQ ID NO: 412 - protein, 7 aa, Artificial Sequence
  Description of Artificial Sequence: Synthetic construct
SDGYYWS

SEQ ID NO: 413 - protein, 9 aa, Artificial Sequence
  Description of Artificial Sequence: Synthetic construct
GGSISSDGY

SEQ ID NO: 414 - protein, 12 aa, Artificial Sequence
  Description of Artificial Sequence: Synthetic construct
GGSISSDGYYWS

SEQ ID NO: 415 - protein, 16 aa, Artificial Sequence
  Description of Artificial Sequence: Synthetic construct
YMYYSGSTYYNPSLKS

SEQ ID NO: 416 - protein, 5 aa, Artificial Sequence
  Description of Artificial Sequence: Synthetic construct
YYSGS

SEQ ID NO: 417 - protein, 8 aa, Artificial Sequence
  Description of Artificial Sequence: Synthetic construct
DFGWYFDL

SEQ ID NO: 418 - protein, 7 aa, Artificial Sequence
  Description of Artificial Sequence: Synthetic construct
SDGYYWS

SEQ ID NO: 419 - protein, 9 aa, Artificial Sequence
  Description of Artificial Sequence: Synthetic construct
GGSVSSDGY

SEQ ID NO: 420 - protein, 12 aa, Artificial Sequence
  Description of Artificial Sequence: Synthetic construct
GGSVSSDGYYWS

SEQ ID NO: 421 - protein, 16 aa, Artificial Sequence
  Description of Artificial Sequence: Synthetic construct
YIYYRRITDYNPSLKS

SEQ ID NO: 422 - protein, 5 aa, Artificial Sequence
  Description of Artificial Sequence: Synthetic construct
YYRRI

SEQ ID NO: 423 - protein, 8 aa, Artificial Sequence
  Description of Artificial Sequence: Synthetic construct
DFGWYFDL

SEQ ID NO: 424 - protein, 5 aa, Artificial Sequence
  Description of Artificial Sequence: Synthetic construct
GYYLH

SEQ ID NO: 425 - protein, 7 aa, Artificial Sequence
  Description of Artificial Sequence: Synthetic construct
GYTFTGY

SEQ ID NO: 426 - protein, 10 aa, Artificial Sequence
  Description of Artificial Sequence: Synthetic construct
GYTFTGYYLH

SEQ ID NO: 427 - protein, 17 aa, Artificial Sequence
  Description of Artificial Sequence: Synthetic construct
WINPNSGGTNYAQKFQG

SEQ ID NO: 428 - protein, 6 aa, Artificial Sequence
  Description of Artificial Sequence: Synthetic construct
NPNSGG

SEQ ID NO: 429 - protein, 13 aa, Artificial Sequence
  Description of Artificial Sequence: Synthetic construct
DRGVTMIVDGMDD

SEQ ID NO: 430 - protein, 5 aa, Artificial Sequence
  Description of Artificial Sequence: Synthetic construct
DYGMH

SEQ ID NO: 431 - protein, 7 aa, Artificial Sequence
  Description of Artificial Sequence: Synthetic construct
GFTFSDY

SEQ ID NO: 432 - protein, 10 aa, Artificial Sequence
  Description of Artificial Sequence: Synthetic construct
GFTFSDYGMH

SEQ ID NO: 433 - protein, 17 aa, Artificial Sequence
  Description of Artificial Sequence: Synthetic construct
VIWYDGSNKYYADSVKG

SEQ ID NO: 434 - protein, 6 aa, Artificial Sequence
  Description of Artificial Sequence: Synthetic construct
WYDGSN

SEQ ID NO: 435 - protein, 11 aa, Artificial Sequence
  Description of Artificial Sequence: Synthetic construct
DEVGFVGAFDI

SEQ ID NO: 436 - protein, 7 aa, Artificial Sequence
  Description of Artificial Sequence: Synthetic construct
SDGYYWS

SEQ ID NO: 437 - protein, 9 aa, Artificial Sequence
  Description of Artificial Sequence: Synthetic construct
GGSISSDGY

SEQ ID NO: 438 - protein, 12 aa, Artificial Sequence
  Description of Artificial Sequence: Synthetic construct
GGSISSDGYYWS

SEQ ID NO: 439 - protein, 16 aa, Artificial Sequence
  Description of Artificial Sequence: Synthetic construct
YMYYSGITYHNPSLKS

SEQ ID NO: 440 - protein, 5 aa, Artificial Sequence
  Description of Artificial Sequence: Synthetic construct
YYSGI

SEQ ID NO: 441 - protein, 8 aa, Artificial Sequence
  Description of Artificial Sequence: Synthetic construct
DFGWYFDL

SEQ ID NO: 442 - protein, 7 aa, Artificial Sequence
  Description of Artificial Sequence: Synthetic construct
SDAYYWS

SEQ ID NO: 443 - protein, 9 aa, Artificial Sequence
  Description of Artificial Sequence: Synthetic construct
GGSISSDAY

SEQ ID NO: 444 - protein, 12 aa, Artificial Sequence
  Description of Artificial Sequence: Synthetic construct
GGSISSDAYYWS

SEQ ID NO: 445 - protein, 16 aa, Artificial Sequence
  Description of Artificial Sequence: Synthetic construct
YMYYSGITYYNPSLKS

SEQ ID NO: 446 - protein, 5 aa, Artificial Sequence
  Description of Artificial Sequence: Synthetic construct
YYSGI

SEQ ID NO: 447 - protein, 8 aa, Artificial Sequence
  Description of Artificial Sequence: Synthetic construct
DFGWYFDL

SEQ ID NO: 448 - protein, 5 aa, Artificial Sequence
  Description of Artificial Sequence: Synthetic construct
DYGIH

SEQ ID NO: 449 - protein, 7 aa, Artificial Sequence
  Description of Artificial Sequence: Synthetic construct
GFTFSDY

SEQ ID NO: 450 - protein, 10 aa, Artificial Sequence
  Description of Artificial Sequence: Synthetic construct
GFTFSDYGIH

SEQ ID NO: 451 - protein, 17 aa, Artificial Sequence
  Description of Artificial Sequence: Synthetic construct
VIWYDGSIKKYSDSVKG

SEQ ID NO: 452 - protein, 6 aa, Artificial Sequence
  Description of Artificial Sequence: Synthetic construct
WYDGSI

SEQ ID NO: 453 - protein, 11 aa, Artificial Sequence
  Description of Artificial Sequence: Synthetic construct
DEVGTFGAFDF

SEQ ID NO: 454 - protein, 5 aa, Artificial Sequence
  Description of Artificial Sequence: Synthetic construct
NAWMS

SEQ ID NO: 455 - protein, 7 aa, Artificial Sequence
  Description of Artificial Sequence: Synthetic construct
GFTFSNA

SEQ ID NO: 456 - protein, 10 aa, Artificial Sequence
  Description of Artificial Sequence: Synthetic construct
GFTFSNAWMS

SEQ ID NO: 457 - protein, 19 aa, Artificial Sequence
  Description of Artificial Sequence: Synthetic construct
RIKSKTGGGTTDYAAPVKG

SEQ ID NO: 458 - protein, 8 aa, Artificial Sequence
  Description of Artificial Sequence: Synthetic construct
KSKTGGGT

SEQ ID NO: 459 - protein, 11 aa, Artificial Sequence
  Description of Artificial Sequence: Synthetic construct
LIVGAISLFDY

SEQ ID NO: 460 - protein, 5 aa, Artificial Sequence
  Description of Artificial Sequence: Synthetic construct
YYFWT

SEQ ID NO: 461 - protein, 7 aa, Artificial Sequence
  Description of Artificial Sequence: Synthetic construct
GGSISYY

SEQ ID NO: 462 - protein, 10 aa, Artificial Sequence
  Description of Artificial Sequence: Synthetic construct
GGSISYYFWT

SEQ ID NO: 463 - protein, 16 aa, Artificial Sequence
  Description of Artificial Sequence: Synthetic construct
QIYYSGNTNSNPSLKS

SEQ ID NO: 464 - protein, 5 aa, Artificial Sequence
  Description of Artificial Sequence: Synthetic construct
YYSGN

SEQ ID NO: 465 - protein, 10 aa, Artificial Sequence
  Description of Artificial Sequence: Synthetic construct
AEGSLDAFDI

SEQ ID NO: 466 - protein, 5 aa, Artificial Sequence
  Description of Artificial Sequence: Synthetic construct
SYSMN

SEQ ID NO: 467 - protein, 7 aa, Artificial Sequence
  Description of Artificial Sequence: Synthetic construct
GFTFSSY

SEQ ID NO: 468 - protein, 10 aa, Artificial Sequence
  Description of Artificial Sequence: Synthetic construct
GFTFSSYSMN

SEQ ID NO: 469 - protein, 17 aa, Artificial Sequence
  Description of Artificial Sequence: Synthetic construct
SISTSSNYIHYADSLQG

SEQ ID NO: 470 - protein, 6 aa, Artificial Sequence
  Description of Artificial Sequence: Synthetic construct
STSSNY

SEQ ID NO: 471 - protein, 13 aa, Artificial Sequence
  Description of Artificial Sequence: Synthetic construct
DKGTTLTNWYFDL

SEQ ID NO: 472 - protein, 5 aa, Artificial Sequence
  Description of Artificial Sequence: Synthetic construct
SYGMH

SEQ ID NO: 473 - protein, 7 aa, Artificial Sequence
  Description of Artificial Sequence: Synthetic construct
GFTFSSY

SEQ ID NO: 474 - protein, 10 aa, Artificial Sequence
  Description of Artificial Sequence: Synthetic construct
GFTFSSYGMH

SEQ ID NO: 475 - protein, 17 aa, Artificial Sequence
  Description of Artificial Sequence: Synthetic construct
VIWYDGSNKYYADSLKG

SEQ ID NO: 476 - protein, 6 aa, Artificial Sequence
  Description of Artificial Sequence: Synthetic construct
WYDGSN

SEQ ID NO: 477 - protein, 12 aa, Artificial Sequence
  Description of Artificial Sequence: Synthetic construct
DGYSGSSDAFDI

SEQ ID NO: 478 - protein, 5 aa, Artificial Sequence
  Description of Artificial Sequence: Synthetic construct
YYYWS

SEQ ID NO: 479 - protein, 7 aa, Artificial Sequence
  Description of Artificial Sequence: Synthetic construct
GGSISYY

SEQ ID NO: 480 - protein, 10 aa, Artificial Sequence
  Description of Artificial Sequence: Synthetic construct
GGSISYYYWS

SEQ ID NO: 481 - protein, 16 aa, Artificial Sequence
  Description of Artificial Sequence: Synthetic construct
NINYMGNTIYNPSLKS

SEQ ID NO: 482 - protein, 5 aa, Artificial Sequence
  Description of Artificial Sequence: Synthetic construct
NYMGN

SEQ ID NO: 483 - protein, 10 aa, Artificial Sequence
  Description of Artificial Sequence: Synthetic construct
AEGSLDAFDF

SEQ ID NO: 484 - protein, 5 aa, Artificial Sequence
  Description of Artificial Sequence: Synthetic construct
GYYIY

SEQ ID NO: 485 - protein, 7 aa, Artificial Sequence
  Description of Artificial Sequence: Synthetic construct
GYIFTGY

SEQ ID NO: 486 - protein, 10 aa, Artificial Sequence
  Description of Artificial Sequence: Synthetic construct
GYIFTGYYIY

SEQ ID NO: 487 - protein, 17 aa, Artificial Sequence
  Description of Artificial Sequence: Synthetic construct
WINPSSGGTNYAQKFQG

SEQ ID NO: 488 - protein, 6 aa, Artificial Sequence
  Description of Artificial Sequence: Synthetic construct
NPSSGG

SEQ ID NO: 489 - protein, 14 aa, Artificial Sequence
  Description of Artificial Sequence: Synthetic construct
DRKREYYYNFGMDV

SEQ ID NO: 490 - protein, 5 aa, Artificial Sequence
  Description of Artificial Sequence: Synthetic construct
SHYIY

SEQ ID NO: 491 - protein, 7 aa, Artificial Sequence
  Description of Artificial Sequence: Synthetic construct
GYTFTSH

SEQ ID NO: 492 - protein, 10 aa, Artificial Sequence
  Description of Artificial Sequence: Synthetic construct
GYTFTSHYIY

SEQ ID NO: 493 - protein, 17 aa, Artificial Sequence
  Description of Artificial Sequence: Synthetic construct
WINPNSGGTNYAQKFQD

SEQ ID NO: 494 - protein, 6 aa, Artificial Sequence
  Description of Artificial Sequence: Synthetic construct
NPNSGG

SEQ ID NO: 495 - protein, 14 aa, Artificial Sequence
  Description of Artificial Sequence: Synthetic construct
DRKREYYYNFGMDV

SEQ ID NO: 496 - protein, 5 aa, Artificial Sequence
  Description of Artificial Sequence: Synthetic construct
SHYIY

SEQ ID NO: 497 - protein, 7 aa, Artificial Sequence
  Description of Artificial Sequence: Synthetic construct
GFTFTSH

SEQ ID NO: 498 - protein, 10 aa, Artificial Sequence
  Description of Artificial Sequence: Synthetic construct
GFTFTSHYIY

SEQ ID NO: 499 - protein, 17 aa, Artificial Sequence
  Description of Artificial Sequence: Synthetic construct
WINPNSGGTKYAQKFQD

SEQ ID NO: 500 - protein, 6 aa, Artificial Sequence
  Description of Artificial Sequence: Synthetic construct
NPNSGG

SEQ ID NO: 501 - protein, 14 aa, Artificial Sequence
  Description of Artificial Sequence: Synthetic construct
DRKREYYYNFGMDV

SEQ ID NO: 502 - protein, 5 aa, Artificial Sequence
  Description of Artificial Sequence: Synthetic construct
IYAIH

SEQ ID NO: 503 - protein, 7 aa, Artificial Sequence
  Description of Artificial Sequence: Synthetic construct
GFTLSIY

SEQ ID NO: 504 - protein, 10 aa, Artificial Sequence
  Description of Artificial Sequence: Synthetic construct
GFTLSIYAIH

SEQ ID NO: 505 - protein, 17 aa, Artificial Sequence
  Description of Artificial Sequence: Synthetic construct
SFGGRGSSTYFADSVKG

SEQ ID NO: 506 - protein, 6 aa, Artificial Sequence
  Description of Artificial Sequence: Synthetic construct
GGRGSS

SEQ ID NO: 507 - protein, 10 aa, Artificial Sequence
  Description of Artificial Sequence: Synthetic construct
EKDWGRGFDY

SEQ ID NO: 508 - protein, 5 aa, Artificial Sequence
  Description of Artificial Sequence: Synthetic construct
NYSMN

SEQ ID NO: 509 - protein, 7 aa, Artificial Sequence
  Description of Artificial Sequence: Synthetic construct
GFTFSNY

SEQ ID NO: 510 - protein, 10 aa, Artificial Sequence
  Description of Artificial Sequence: Synthetic construct
GFTFSNYSMN

SEQ ID NO: 511 - protein, 17 aa, Artificial Sequence
  Description of Artificial Sequence: Synthetic construct
SISSSTIYIYYADSVKG

SEQ ID NO: 512 - protein, 6 aa, Artificial Sequence
  Description of Artificial Sequence: Synthetic construct
SSSTIY

SEQ ID NO: 513 - protein, 13 aa, Artificial Sequence
  Description of Artificial Sequence: Synthetic construct
DIGWEVFTLGFDY

SEQ ID NO: 514 - protein, 11 aa, Artificial Sequence
  Description of Artificial Sequence: Synthetic construct
RASQSISTWLA

SEQ ID NO: 515 - protein, 7 aa, Artificial Sequence
  Description of Artificial Sequence: Synthetic construct
KASSLES

SEQ ID NO: 516 - protein, 9 aa, Artificial Sequence
  Description of Artificial Sequence: Synthetic construct
QQYKSYSHT

SEQ ID NO: 517 - protein, 11 aa, Artificial Sequence
  Description of Artificial Sequence: Synthetic construct
RASQSISSWLA

SEQ ID NO: 518 - protein, 7 aa, Artificial Sequence
  Description of Artificial Sequence: Synthetic construct
KASSLES

SEQ ID NO: 519 - protein, 9 aa, Artificial Sequence
  Description of Artificial Sequence: Synthetic construct
QQYKSFSLT

SEQ ID NO: 520 - protein, 11 aa, Artificial Sequence
  Description of Artificial Sequence: Synthetic construct
RASQSISSWLA

SEQ ID NO: 521 - protein, 7 aa, Artificial Sequence
  Description of Artificial Sequence: Synthetic construct
KASTLES

SEQ ID NO: 522 - protein, 9 aa, Artificial Sequence
  Description of Artificial Sequence: Synthetic construct
QQYNSYSYT

SEQ ID NO: 523 - protein, 11 aa, Artificial Sequence
  Description of Artificial Sequence: Synthetic construct
RASQSVSSWLA

SEQ ID NO: 524 - protein, 7 aa, Artificial Sequence
  Description of Artificial Sequence: Synthetic construct
KASSLES

SEQ ID NO: 525 - protein, 9 aa, Artificial Sequence
  Description of Artificial Sequence: Synthetic construct
QQYNTYSHT

SEQ ID NO: 526 - protein, 11 aa, Artificial Sequence
  Description of Artificial Sequence: Synthetic construct
RASQGIRNDLG

SEQ ID NO: 527 - protein, 7 aa, Artificial Sequence
  Description of Artificial Sequence: Synthetic construct
AASSLQS

SEQ ID NO: 528 - protein, 9 aa, Artificial Sequence
  Description of Artificial Sequence: Synthetic construct
LQDYNYPFT

SEQ ID NO: 529 - protein, 11 aa, Artificial Sequence
  Description of Artificial Sequence: Synthetic construct
RASQDIDNYLA

SEQ ID NO: 530 - protein, 7 aa, Artificial Sequence
  Description of Artificial Sequence: Synthetic construct
AASALQS

SEQ ID NO: 531 - protein, 9 aa, Artificial Sequence
  Description of Artificial Sequence: Synthetic construct
QNYNSGPRT

SEQ ID NO: 532 - protein, 11 aa, Artificial Sequence
  Description of Artificial Sequence: Synthetic construct
RASQDISNYLT

SEQ ID NO: 533 - protein, 7 aa, Artificial Sequence
  Description of Artificial Sequence: Synthetic construct
AASALQS

SEQ ID NO: 534 - protein, 9 aa, Artificial Sequence
  Description of Artificial Sequence: Synthetic construct
QNYNSAPRT

SEQ ID NO: 535 - protein, 16 aa, Artificial Sequence
  Description of Artificial Sequence: Synthetic construct
RSSQSLLHSNGYNYLD

SEQ ID NO: 536 - protein, 7 aa, Artificial Sequence
  Description of Artificial Sequence: Synthetic construct
LGSNRAS

SEQ ID NO: 537 - protein, 9 aa, Artificial Sequence
  Description of Artificial Sequence: Synthetic construct
MQTLQTPFT

SEQ ID NO: 538 - protein, 11 aa, Artificial Sequence
  Description of Artificial Sequence: Synthetic construct
RASQGINSHLA

SEQ ID NO: 539 - protein, 7 aa, Artificial Sequence
  Description of Artificial Sequence: Synthetic construct
YASTLPS

SEQ ID NO: 540 - protein, 9 aa, Artificial Sequence
  Description of Artificial Sequence: Synthetic construct
QQLNHYPIT

SEQ ID NO: 541 - protein, 11 aa, Artificial Sequence
  Description of Artificial Sequence: Synthetic construct
RASQGISNYLA

SEQ ID NO: 542 - protein, 7 aa, Artificial Sequence
  Description of Artificial Sequence: Synthetic construct
AASTLHS

SEQ ID NO: 543 - protein, 9 aa, Artificial Sequence
  Description of Artificial Sequence: Synthetic construct
QKYNSAPRT

SEQ ID NO: 544 - protein, 11 aa, Artificial Sequence
  Description of Artificial Sequence: Synthetic construct
RASQDISNYLA

SEQ ID NO: 545 - protein, 7 aa, Artificial Sequence
  Description of Artificial Sequence: Synthetic construct
AASTLHS

SEQ ID NO: 546 - protein, 9 aa, Artificial Sequence
  Description of Artificial Sequence: Synthetic construct
QKYNSAPRT

SEQ ID NO: 547 - protein, 11 aa, Artificial Sequence
  Description of Artificial Sequence: Synthetic construct
RASQDISSFLA

SEQ ID NO: 548 - protein, 7 aa, Artificial Sequence
  Description of Artificial Sequence: Synthetic construct
VASTLQS

SEQ ID NO: 549 - protein, 9 aa, Artificial Sequence
  Description of Artificial Sequence: Synthetic construct
QQLHVYPIT

SEQ ID NO: 550 - protein, 17 aa, Artificial Sequence
  Description of Artificial Sequence: Synthetic construct
RSSQSLLDSDDGNTYLD

SEQ ID NO: 551 - protein, 7 aa, Artificial Sequence
  Description of Artificial Sequence: Synthetic construct
TLSYRAS

SEQ ID NO: 552 - protein, 9 aa, Artificial Sequence
  Description of Artificial Sequence: Synthetic construct
MQRIEFPFT

SEQ ID NO: 553 - protein, 11 aa, Artificial Sequence
  Description of Artificial Sequence: Synthetic construct
RASQTISTWLA

SEQ ID NO: 554 - protein, 7 aa, Artificial Sequence
  Description of Artificial Sequence: Synthetic construct
KASNLES

SEQ ID NO: 555 - protein, 9 aa, Artificial Sequence
  Description of Artificial Sequence: Synthetic construct
QQYQTFSHT

SEQ ID NO: 556 - protein, 11 aa, Artificial Sequence
  Description of Artificial Sequence: Synthetic construct
RASQGISNYLA

SEQ ID NO: 557 - protein, 7 aa, Artificial Sequence
  Description of Artificial Sequence: Synthetic construct
AASTLQS

SEQ ID NO: 558 - protein, 9 aa, Artificial Sequence
  Description of Artificial Sequence: Synthetic construct
QKYNSAPLT

SEQ ID NO: 559 - protein, 16 aa, Artificial Sequence
  Description of Artificial Sequence: Synthetic construct
RSSQTLVHSNGYNYLN

SEQ ID NO: 560 - protein, 7 aa, Artificial Sequence
  Description of Artificial Sequence: Synthetic construct
LGSNRAS

SEQ ID NO: 561 - protein, 9 aa, Artificial Sequence
  Description of Artificial Sequence: Synthetic construct
MQAIQTPYT

SEQ ID NO: 562 - protein, 11 aa, Artificial Sequence
  Description of Artificial Sequence: Synthetic construct
RASQSISSWLA

SEQ ID NO: 563 - protein, 7 aa, Artificial Sequence
  Description of Artificial Sequence: Synthetic construct
KASNLES

SEQ ID NO: 564 - protein, 9 aa, Artificial Sequence
  Description of Artificial Sequence: Synthetic construct
QQYNSYSCT

SEQ ID NO: 565 - protein, 11 aa, Artificial Sequence
  Description of Artificial Sequence: Synthetic construct
QASQDINNYLH

SEQ ID NO: 566 - protein, 7 aa, Artificial Sequence
  Description of Artificial Sequence: Synthetic construct
DASDWET

SEQ ID NO: 567 - protein, 9 aa, Artificial Sequence
  Description of Artificial Sequence: Synthetic construct
QQYDHLPIT

SEQ ID NO: 568 - protein, 11 aa, Artificial Sequence
  Description of Artificial Sequence: Synthetic construct
QASQDISNYLH

SEQ ID NO: 569 - protein, 7 aa, Artificial Sequence
  Description of Artificial Sequence: Synthetic construct
DASDLET

SEQ ID NO: 570 - protein, 9 aa, Artificial Sequence
  Description of Artificial Sequence: Synthetic construct
QQYDHLPIT

SEQ ID NO: 571 - protein, 11 aa, Artificial Sequence
  Description of Artificial Sequence: Synthetic construct
QASQDISNYLH

SEQ ID NO: 572 - protein, 7 aa, Artificial Sequence
  Description of Artificial Sequence: Synthetic construct
DASDLET

SEQ ID NO: 573 - protein, 9 aa, Artificial Sequence
  Description of Artificial Sequence: Synthetic construct
QQYDHLPIT

SEQ ID NO: 574 - protein, 11 aa, Artificial Sequence
  Description of Artificial Sequence: Synthetic construct
QASQDISNYLN

SEQ ID NO: 575 - protein, 7 aa, Artificial Sequence
  Description of Artificial Sequence: Synthetic construct
DASNLET

SEQ ID NO: 576 - protein, 9 aa, Artificial Sequence
  Description of Artificial Sequence: Synthetic construct
QQYDNLPYT

SEQ ID NO: 577 - protein, 16 aa, Artificial Sequence
  Description of Artificial Sequence: Synthetic construct
RSSQSLLYSNGYNYLD

SEQ ID NO: 578 - protein, 7 aa, Artificial Sequence
  Description of Artificial Sequence: Synthetic construct
LNSNRAS

SEQ ID NO: 579 - protein, 9 aa, Artificial Sequence
  Description of Artificial Sequence: Synthetic construct
MQALQTPLT

SEQ ID NO: 580 - protein, 489 aa, Artificial Sequence
  Description of Artificial Sequence: Synthetic construct
MALPVTALLLPLALLLHAARPQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 581 - protein, 484 aa, Artificial Sequence
  Description of Artificial Sequence: Synthetic construct
MALPVTALLLPLALLLHAARPEVQLVESGGGLIQPGGSLRLSCAASGFTVSSNYMTWVRQAPGKGLEWVSVIYSGGSTYYADSVKGRFTISRDNSKNTLYLQMNSLRAEDTAVYYCARNWGDYWGQGTLVTVSSGGGGSGGGGSGGGGSGGGGSDIQMTQSPSTLSASVGDRVTITCRASQSISSWLAWYQQKPGKAPKVLIYKASSLESGVPSRFSGSGSGTEFTLTINSLQPDDFATYYCQQYKSFSLTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 582 - protein, 489 aa, Artificial Sequence
  Description of Artificial Sequence: Synthetic construct
MALPVTALLLPLALLLHAARPQVQLQESGPGLVKPSGTLSLTCTVSGGSIDYYFWNWFRQSPVKGLEWIGHVYDIGNTKYNPSLKSRVTISIDTSENQFSLKLNSVTAADTAVYYCARGEGALDAFDIWGQGTMVTVSSGGGGSGGGGSGGGGSGGGGSDIQMTQSPSTLSASVGDRVTITCRASQSISSWLAWYQQKPGKAPKVLIYKASTLESGVPSRFSGSGSGTEFTLTISSLQPDDFATYYCQQYNSYSYTFGHGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 583 - protein, 489 aa, Artificial Sequence
  Description of Artificial Sequence: Synthetic construct
MALPVTALLLPLALLLHAARPQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 584 - protein, 491 aa, Artificial Sequence
  Description of Artificial Sequence: Synthetic construct
MALPVTALLLPLALLLHAARPQVQLVESGGGVVQPGRSLRLSCVASGFTFSDYGIHWVRQAPGMGQEWVAVIWYDGSIKKYSDSVKGRFIISRDNSENTVYLQMNSLRGEDTAIYYCARDEVGTFGAFDFWGQGTKVTVSSGGGGSGGGGSGGGGSGGGGSAIQMTQSPSSLSASVGDRVTITCRASQGIRNDLGWYQQKPGKAPKLLIYAASSLQSGVPSRFSGSGSGTDFTLTISSLQPEDFATYYCLQDYNYPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 585 - protein, 489 aa, Artificial Sequence
  Description of Artificial Sequence: Synthetic construct
MALPVTALLLPLALLLHAARPQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 586 - protein, 489 aa, Artificial Sequence
  Description of Artificial Sequence: Synthetic construct
MALPVTALLLPLALLLHAARPQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 587 - protein, 498 aa, Artificial Sequence
  Description of Artificial Sequence: Synthetic construct
MALPVTALLLPLALLLHAARPQVQLVQSGAEVKKPGASVKVSCKASGYTFTGYYLHWVRQAPGQGLEWMGWINPNSGGTNYAQKFQGRVTMTRDTSITTAYMELSRLRIDDTAVYYCARDRGVTMIVDGMDDWGQGTTVTVSSGGGGSGGGGSGGGGSGGGGSDIVMTQSPLSLPVTPGEPASISCRSSQSLLHSNGYNYLDWYLQKPGQSPQVLILLGSNRASGVPDRVSASGSGTDFTLKISRMQAEDVGIYYCMQTLQTPFTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 588 - protein, 491 aa, Artificial Sequence
  Description of Artificial Sequence: Synthetic construct
MALPVTALLLPLALLLHAARPEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 589 - protein, 489 aa, Artificial Sequence
  Description of Artificial Sequence: Synthetic construct
MALPVTALLLPLALLLHAARPQVQLQESGPGLVKPSQTLSLTCTVSGGSISSDGYYWSWIRQHPGKGLEWIGYMYYSGITYHNPSLKSRVTISVDTSKNQFSLRLSSVTAADTAVYYCARDFGWYFDLWGRGTLVTVSSGGGGSGGGGSGGGGSGGGGSDIQMTQSPSSLSASVGDRVTITCRASQGISNYLAWYQQKPGKVPKLLIYAASTLHSGVPSRFSGSGSGTDFTLTISSLQPEDVATYYCQKYNSAPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 590 - protein, 489 aa, Artificial Sequence
  Description of Artificial Sequence: Synthetic construct
MALPVTALLLPLALLLHAARPQVQLQESGPGLVKPSQTLSLTCTVSGGSISSDAYYWSWIRQHPGKGLEWIGYMYYSGITYYNPSLKSRVTISVDTSKNQFSLKLSSVTAADTAVYYCARDFGWYFDLWGRGTLVTVSSGGGGSGGGGSGGGGSGGGGSDIQMTQSPSSLSASVGDRVTITCRASQDISNYLAWYQQKPGKVPKLLIYAASTLHSGVPSRFSGSGSGTDFTLTISSLQPDDFAAYYCQKYNSAPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 591 - protein, 491 aa, Artificial Sequence
  Description of Artificial Sequence: Synthetic construct
MALPVTALLLPLALLLHAARPQVQLVESGGGVVQPGRSLRLSCVASGFTFSDYGIHWVRQAPGMGQEWVAVIWYDGSIKKYSDSVKGRFIISRDNSENTVYLQMNSLRGEDTAIYYCARDEVGTFGAFDFWGQGTKVTVSSGGGGSGGGGSGGGGSGGGGSDIQLTQSPSFLSASVGDRVSITCRASQDISSFLAWYQQKPGKAPVLLIYVASTLQSGVPSRFSGSGSGTEFTLTVSSLQPEDFATYYCQQLHVYPITFGQGTRLEIRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 592 - protein, 499 aa, Artificial Sequence
  Description of Artificial Sequence: Synthetic construct
MALPVTALLLPLALLLHAARPEVQLVESGGGLVKPGGSLRLSCAASGFTFSNAWMSWVRQAPGKGLEWVGRIKSKTGGGTTDYAAPVKGRFTISRDDSKNTLYLQMNSLKTEDTAVYYCTSLIVGAISLFDYWGQGTLVTVSSGGGGSGGGGSGGGGSGGGGSDIVMTQTPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPFTFGPGTKVDIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 593 - protein, 489 aa, Artificial Sequence
  Description of Artificial Sequence: Synthetic construct
MALPVTALLLPLALLLHAARPQVQLRESGPGLVKPSETLSLTCTISGGSISYYFWTWIRQPPGRGLEWIGQIYYSGNTNSNPSLKSRVTISIDTSKNQFSLKLTSVTVADTAVYYCVRAEGSLDAFDIWGQGTMVAVSSGGGGSGGGGSGGGGSGGGGSDIQMTQSPSALSASVGDRVAITCRASQTISTWLAWYQQKPGKAPKVLIYKASNLESGVPSRFSGSGSGTEFTLTINSLQPDDFATYYCQQYQTFSHTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 594 - protein, 493 aa, Artificial Sequence
  Description of Artificial Sequence: Synthetic construct
MALPVTALLLPLALLLHAARPEVQLVESGGGLVKPGGSLRLSCVASGFTFSSYSMNWVRQFPGKGLEWVSSISTSSNYIHYADSLQGRFTISRDNAKNSLYLQMSSLRVEDTAVYYCVRDKGTTLTNWYFDLWGRGTLVTVSSGGGGSGGGGSGGGGSGGGGSDMQMTQSPSSLSASVGDRVTLTCRASQGISNYLAWFQLKPGKVPKLLIYAASTLQSGVPSRFSGSGSGTDFALTISSLQPEDVATYYCQKYNSAPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 595 - protein, 497 aa, Artificial Sequence
  Description of Artificial Sequence: Synthetic construct
MALPVTALLLPLALLLHAARPQVQLVESGGGVVQPGRSLRLSCGASGFTFSSYGMHWVRQAPGKGLEWVAVIWYDGSNKYYADSLKGRFTISRDNSKNTLYLQMNSLRAEDTAVYYCARDGYSGSSDAFDIWGQGTMVTVSSGGGGSGGGGSGGGGSGGGGSDIVMTQSPLSLPVTPGEPASISCRSSQTLVHSNGYNYLNWYLQKPGQSPQLLIYLGSNRASGVPDRFSGSGSGSDFTLKISRMEAEDVGVYYCMQAIQTPYTFGQGTNVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 596 - protein, 489 aa, Artificial Sequence
  Description of Artificial Sequence: Synthetic construct
MALPVTALLLPLALLLHAARPQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 597 - protein, 494 aa, Artificial Sequence
  Description of Artificial Sequence: Synthetic construct
MALPVTALLLPLALLLHAARPQVQLVQSGAEVTKPGASVKVSCKASGYIFTGYYIYWVRQAPGQGLEWMGWINPSSGGTNYAQKFQGRVTMARDTSISTAYMELSSLRSDDTAVYYCARDRKREYYYNFGMDVWGQGTTVTVSTGGGGSGGGGSGGGGSGGGGSDIQMTQSPSSLSASVGDRIIFTCQASQDINNYLHWYQQKPGKAPKLLIYDASDWETGVPSRFSGSGSGTDFTFTISSLQPEDIATYYCQQYDHLPITFGQGTRVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 598 - protein, 494 aa, Artificial Sequence
  Description of Artificial Sequence: Synthetic construct
MALPVTALLLPLALLLHAARPQVQLVQSGAEVTKPGASVKVSCKASGYTFTSHYIYWVRQAPGQGLEWMGWINPNSGGTNYAQKFQDRVTMARDTSISTAYMELSRLRSDDTAVYYCAKDRKREYYYNFGMDVWGQGTTVTVSAGGGGSGGGGSGGGGSGGGGSDIQMTQSPSSLSASVGDRVILTCQASQDISNYLHWYQQKPGKAPKLLIYDASDLETGVPSRFSGSGSGADFTFTISNLQPEDFATYYCQQYDHLPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 599 - protein, 494 aa, Artificial Sequence
  Description of Artificial Sequence: Synthetic construct
MALPVTALLLPLALLLHAARPQVQLVQFGVEVRKPGASVKVSCKVSGFTFTSHYIYWVRQAPGQGLEWMGWINPNSGGTKYAQKFQDRVTMARDTSISTAYMELSRLRSDDTSVYYCVKDRKREYYYNFGMDVWGQGTTVTVSSGGGGSGGGGSGGGGSGGGGSDIQMTQSPSSLSASVGDRVILTCQASQDISNYLHWYQQKPGKAPKLLIYDASDLETGVPSRFSGSGSGADFTFTISNLQPEDFATYYCQQYDHLPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 600 - protein, 490 aa, Artificial Sequence
  Description of Artificial Sequence: Synthetic construct
MALPVTALLLPLALLLHAARPEVQMLESGGGLIQPGGSLRLSCKTSGFTLSIYAIHWVRQAPGRGLEWVSSFGGRGSSTYFADSVKGRFTISRDASENSLYLHMNSLRAEDTAVYYCAKEKDWGRGFDYWGQGTLVTVSSGGGGSGGGGSGGGGSGGGGSDIQMTQSPSSLSASVGDRVTITCQASQDISNYLNWYQQKPGKAPKLLIYDASNLETGVPSRFSGSGSGTDFTFTISSLQPEDIATYYCQQYDNLPYTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 601 - protein, 498 aa, Artificial Sequence
  Description of Artificial Sequence: Synthetic construct
MALPVTALLLPLALLLHAARPEVQLVESGGGLVKPGGSLRLSCAASGFTFSNYSMNWVRQAPGKGLEWVSSISSSTIYIYYADSVKGRFTISRDNAKKSLYLQMNSLRAEDTAVYYCARDIGWEVFTLGFDYWGQGTQVTVSSGGGGSGGGGSGGGGSGGGGSDIVMTQSPLSLPVTPGEPASISCRSSQSLLYSNGYNYLDWYLQKPGQSPQLLIFLNSNRASGVPDRFSGSGSGTDFTLKISRVEAEDVGVYFCMQALQTPLTFGGGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 602 - protein, 20 aa, Artificial Sequence
  Description of Artificial Sequence: Synthetic peptide
GGGGSGGGGSGGGGSGGGGS

SEQ ID NO: 603 - protein, 12 aa, Artificial Sequence
  Description of Artificial Sequence: Synthetic peptide
CQFDLSTRRLKC

SEQ ID NO: 604 - protein, 12 aa, Artificial Sequence
  Description of Artificial Sequence: Synthetic peptide
CQYNLSSRALKC

SEQ ID NO: 605 - protein, 12 aa, Artificial Sequence
  Description of Artificial Sequence: Synthetic peptide
CVWQRWQKSYVC

SEQ ID NO: 606 - protein, 12 aa, Artificial Sequence
  Description of Artificial Sequence: Synthetic peptide
CMWDRFSRWYKC

SEQ ID NO: 607 - protein, 25 aa, Artificial Sequence
  Description of Artificial Sequence: Synthetic peptide
SFVLNWYRMSPSNQTDKLAAFPEDR

SEQ ID NO: 608 - protein, 19 aa, Artificial Sequence
  Description of Artificial Sequence: Synthetic peptide
SGTYLCGAISLAPKAQIKE

SEQ ID NO: 609 - protein, 16 aa, Artificial Sequence
  Description of Artificial Sequence: Synthetic peptide
ELPTQGTFSNVSTNVS

SEQ ID NO: 610 - protein, 12 aa, Artificial Sequence
  Description of Artificial Sequence: Synthetic peptide
GQNDTSQTSSPS

SEQ ID NO: 611 - protein, 21 aa, Artificial Sequence
  Description of Artificial Sequence: Synthetic peptide
MGTSLLCWMALCLLGADHADA

SEQ ID NO: 612 - protein, 18 aa, Artificial Sequence
  Description of Artificial Sequence: Synthetic peptide
GSTSGSGKPGSGEGSTKG

SEQ ID NO: 613 - protein, 25 aa, Artificial Sequence
  Description of Artificial Sequence: Synthetic peptide
  MISC_FEATURE (1)..(25): This sequence may encompass 1-5 "Gly Gly Gly Gly Ser" repeating units
GGGGSGGGGSGGGGSGGGGSGGGGS

SEQ ID NO: 614 - protein, 5 aa, Artificial Sequence
  Description of Artificial Sequence: Synthetic peptide
SGGGG

SEQ ID NO: 615 - protein, 5 aa, Artificial Sequence
  Description of Artificial Sequence: Synthetic peptide
GGGGS

SEQ ID NO: 616 - protein, 6 aa, Artificial Sequence
  Description of Artificial Sequence: Synthetic peptide
SGGGGS

SEQ ID NO: 617 - protein, 25 aa, Artificial Sequence
  Description of Artificial Sequence: Synthetic peptide
GGGGSCPYSNPSLCSGGGGSGGGGS

SEQ ID NO: 618 - protein, 55 aa, Artificial Sequence
  Description of Artificial Sequence: Synthetic polypeptide
GSGGGGSCPYSNPSLCSGGGGSELPTQGTFSNVSTNVSPAKPTTTACPYSNPSLC

SEQ ID NO: 619 - protein, 489 aa, Artificial Sequence
  Description of Artificial Sequence: Synthetic polypeptide
MALPVTALLLPLALLLHAARPQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 620 - protein, 526 aa, Artificial Sequence
  Description of Artificial Sequence: Synthetic polypeptide
MALPVTALLLPLALLLHAARPQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 621 - protein, 536 aa, Artificial Sequence
  Description of Artificial Sequence: Synthetic polypeptide
MALPVTALLLPLALLLHAARPEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 622 - protein, 526 aa, Artificial Sequence
  Description of Artificial Sequence: Synthetic polypeptide
MALPVTALLLPLALLLHAARPQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 623 - protein, 526 aa, Artificial Sequence
  Description of Artificial Sequence: Synthetic polypeptide
MALPVTALLLPLALLLHAARPQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 624 - protein, 526 aa, Artificial Sequence
  Description of Artificial Sequence: Synthetic polypeptide
MALPVTALLLPLALLLHAARPQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 625 - protein, 526 aa, Artificial Sequence
  Description of Artificial Sequence: Synthetic polypeptide
MALPVTALLLPLALLLHAARPQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 626 - protein, 528 aa, Artificial Sequence
  Description of Artificial Sequence: Synthetic polypeptide
MALPVTALLLPLALLLHAARPEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 627 - protein, 526 aa, Artificial Sequence
  Description of Artificial Sequence: Synthetic polypeptide
MALPVTALLLPLALLLHAARPQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 628 - protein, 569 aa, Artificial Sequence
  Description of Artificial Sequence: Synthetic polypeptide
MALPVTALLLPLALLLHAARPGGGGSCPYSNPSLCSGGGGSGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 629 - protein, 579 aa, Artificial Sequence
  Description of Artificial Sequence: Synthetic polypeptide
MALPVTALLLPLALLLHAARPGGGGSCPYSNPSLCSGGGGSGGGGSEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 630 - protein, 569 aa, Artificial Sequence
  Description of Artificial Sequence: Synthetic polypeptide
MALPVTALLLPLALLLHAARPGGGGSCPYSNPSLCSGGGGSGGGGSQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 631 - protein, 569 aa, Artificial Sequence
  Description of Artificial Sequence: Synthetic polypeptide
MALPVTALLLPLALLLHAARPGGGGSCPYSNPSLCSGGGGSGGGGSQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 632 - protein, 569 aa, Artificial Sequence
  Description of Artificial Sequence: Synthetic polypeptide
MALPVTALLLPLALLLHAARPGGGGSCPYSNPSLCSGGGGSGGGGSQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 633 - protein, 569 aa, Artificial Sequence
  Description of Artificial Sequence: Synthetic polypeptide
MALPVTALLLPLALLLHAARPGGGGSCPYSNPSLCSGGGGSGGGGSQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 634 - protein, 571 aa, Artificial Sequence
  Description of Artificial Sequence: Synthetic polypeptide
MALPVTALLLPLALLLHAARPGGGGSCPYSNPSLCSGGGGSGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 635 - protein, 569 aa, Artificial Sequence
  Description of Artificial Sequence: Synthetic polypeptide
MALPVTALLLPLALLLHAARPGGGGSCPYSNPSLCSGGGGSGGGGSQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 636 - protein, 527 aa, Artificial Sequence
  Description of Artificial Sequence: Synthetic polypeptide
MALPVTALLLPLALLLHAARPGGGGSCPYSNPSLCGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 637 - protein, 537 aa, Artificial Sequence
  Description of Artificial Sequence: Synthetic polypeptide
MALPVTALLLPLALLLHAARPGGGGSCPYSNPSLCGGGGSEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 638 - protein, 527 aa, Artificial Sequence
  Description of Artificial Sequence: Synthetic polypeptide
MALPVTALLLPLALLLHAARPGGGGSCPYSNPSLCGGGGSQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 639 - protein, 527 aa, Artificial Sequence
  Description of Artificial Sequence: Synthetic polypeptide
MALPVTALLLPLALLLHAARPGGGGSCPYSNPSLCGGGGSQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 640 - protein, 527 aa, Artificial Sequence
  Description of Artificial Sequence: Synthetic polypeptide
MALPVTALLLPLALLLHAARPGGGGSCPYSNPSLCGGGGSQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 641 - protein, 527 aa, Artificial Sequence
  Description of Artificial Sequence: Synthetic polypeptide
MALPVTALLLPLALLLHAARPGGGGSCPYSNPSLCGGGGSQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 642 - protein, 529 aa, Artificial Sequence
  Description of Artificial Sequence: Synthetic polypeptide
MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 643 - protein, 527 aa, Artificial Sequence
  Description of Artificial Sequence: Synthetic polypeptide
MALPVTALLLPLALLLHAARPGGGGSCPYSNPSLCGGGGSQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 644 - protein, 522 aa, Artificial Sequence
  Description of Artificial Sequence: Synthetic polypeptide
MALPVTALLLPLALLLHAARPGGGGSCPYSNPSLCGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 645 - protein, 532 aa, Artificial Sequence
  Description of Artificial Sequence: Synthetic polypeptide
MALPVTALLLPLALLLHAARPGGGGSCPYSNPSLCGGGGSEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 646 - protein, 522 aa, Artificial Sequence
  Description of Artificial Sequence: Synthetic polypeptide
MALPVTALLLPLALLLHAARPGGGGSCPYSNPSLCGGGGSQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 647 - protein, 522 aa, Artificial Sequence
  Description of Artificial Sequence: Synthetic polypeptide
MALPVTALLLPLALLLHAARPGGGGSCPYSNPSLCGGGGSQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 648 - protein, 522 aa, Artificial Sequence
  Description of Artificial Sequence: Synthetic polypeptide
MALPVTALLLPLALLLHAARPGGGGSCPYSNPSLCGGGGSQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 649 - protein, 522 aa, Artificial Sequence
  Description of Artificial Sequence: Synthetic polypeptide
MALPVTALLLPLALLLHAARPGGGGSCPYSNPSLCGGGGSQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 650 - protein, 524 aa, Artificial Sequence
  Description of Artificial Sequence: Synthetic polypeptide
MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 651 - protein, 522 aa, Artificial Sequence
  Description of Artificial Sequence: Synthetic polypeptide
MALPVTALLLPLALLLHAARPGGGGSCPYSNPSLCGGGGSQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 652 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 653 - protein, 532 aa, Artificial Sequence
  Description of Artificial Sequence: Synthetic polypeptide
MALPVTALLLPLALLLHAARPGGGGSCPYSNPSLCGGGGSCPYSNPSLCGGGGSEVQLVQSGAEVKKPGESLKISCKGSGYGFTSYWIGWVRQMPGKGLEWMGIIHPDDSDTKYSPSFQGQVTISADKSISTAYLQWSSLKASDTAMYYCASSYLRGLWGGYFDYWGQGTLVTVSSGGGGSGGGGSGGGGSGGGGSELQSVLTQPPSASGTPGQRVTISCSGSSSNIGSNYVNWYQQLPGTAPKLLIYGDYQRPSGVPDRFSGSKSGTSASLAISGLRSEDEADYYCATRDDSLSGSVVFGTGTKLTVLTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 654 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQESGPGLVKPSETLSLTCTVSGGSISYYYWTWIRQPPGKGLEWIGHIYYSGSTNYNPSLKSRVTISIDTSKNLFSLKLSSVTAADTAVYYCARAEGSLDAFDFWGQGTMVTVSSGGGGSGGGGSGGGGSGGGGSDIQMTQSPSTLSASVGDRVTITCRASQSISTWLAWYQQKPGKAPKVLIYKASSLESGVPSRFSGSGSGTEFILTINSLQPDDFASYYCQQYKSYSHTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 655 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQESGPGLVKPSETLSLNCTVSGGSISYYYWTWIRQPPGKGLEWIGHVIYSGTTNYNPSLKSRVTISVDTSKNQFSLKLNSVTAADTAVYYCVRAEGSLDAFDLWGQGTMVTVSSGGGGSGGGGSGGGGSGGGGSDIQMTQSPSILSASVGDRVTITCRASQSVSSWLAWYQQKPGKAPKVLIYKASSLESGVPSRFSGTGSGTEFTLTISSLQSDDFATYYCQQYNTYSHTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 656 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQESGPGLVKPLQTLSLTCTVSGGSISSDGYYWSWIRQNPGKGLEWIGYMYYSGSTYYNPSLKSRVTISVDTSKNQFSLKLRSVTAADTAVYYCTRDFGWYFDLWGRGTLVTVSSGGGGSGGGGSGGGGSGGGGSDIQMTQSPSSLSASVGDSITITCRASQDIDNYLAWYQQKTGKVPKVLIYAASALQSGVPSRFSGSGSGTDFTLTISSLQPEDVATYYCQNYNSGPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 657 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQESGPGLVKPSQSLSLTCSVSGGSVSSDGYYWSWIRQHPGKGLEWIGYIYYRRITDYNPSLKSRVNISLDTSKNQFSLKLSSVTAADTAVYYCARDFGWYFDLWGRGTLVAVSSGGGGSGGGGSGGGGSGGGGSDIQMTQSPSSLSASVGDRVTITCRASQDISNYLTWYQQKPGRVPEVLIYAASALQSGVPSRFSGSGSGTDFTLTISSLQPEDVATYYCQNYNSAPRTFGQGTKVEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 658 - protein, 524 aa, Artificial Sequence
  Description of Artificial Sequence: Synthetic polypeptide
MALPVTALLLPLALLLHAARPGGGGSCPYSNPSLCGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLDINTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 659 - protein, 522 aa, Artificial Sequence
  Description of Artificial Sequence: Synthetic polypeptide
MALPVTALLLPLALLLHAARPGGGGSCPYSNPSLCGGGGSCPYSNPSLCGGGGSQVQLQESGPGLVQPSETLSLTCTVSGGSISYYYWSWIRQPPGKGLEWIGNINYMGNTIYNPSLKSRVTISVDTSKDQFSLKLTSVSAADTAVYYCVRAEGSLDAFDFWGQGTLVAVSLGGGGSGGGGSGGGGSGGGGSDIQMTQSPSTLSASVGDRVTITCRASQSISSWLAWYQQKPGKAPKVLIYKASNLESGVPSRFSGSGSGTEFTLTISSLQPDDFATYYCQQYNSYSCTFGQGTKLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 660 - protein, 24 aa, Artificial Sequence
  Description of Artificial Sequence: Synthetic peptide
NSELLSLINDMPITNDQKKLMSNN

SEQ ID NO: 661 - protein, 107 aa, Artificial Sequence
  Description of Artificial Sequence: Synthetic polypeptide
DIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIK

SEQ ID NO: 662 - protein, 120 aa, Artificial Sequence; identical to SEQ ID NO: 355
  Description of Artificial Sequence: Synthetic polypeptide

SEQ ID NO: 663 - protein, 5 aa, Artificial Sequence
  Description of Artificial Sequence: Synthetic peptide
DYGMH

SEQ ID NO: 664 - protein, 7 aa, Artificial Sequence
  Description of Artificial Sequence: Synthetic peptide
GFTFSDY

SEQ ID NO: 665 - protein, 10 aa, Artificial Sequence
  Description of Artificial Sequence: Synthetic peptide
GFTFSDYGMH

SEQ ID NO: 666 - protein, 17 aa, Artificial Sequence
  Description of Artificial Sequence: Synthetic peptide
VIWYDGSNKYYADSVKG

SEQ ID NO: 667 - protein, 6 aa, Artificial Sequence
  Description of Artificial Sequence: Synthetic peptide
WYDGSN

SEQ ID NO: 668 - protein, 11 aa, Artificial Sequence
  Description of Artificial Sequence: Synthetic peptide
DEVGFVGAFDI

SEQ ID NO: 669 - protein, 11 aa, Artificial Sequence
  Description of Artificial Sequence: Synthetic peptide
RASQGINSHLA

SEQ ID NO: 670 - protein, 7 aa, Artificial Sequence
  Description of Artificial Sequence: Synthetic peptide
YASTLPS

SEQ ID NO: 671 - protein, 9 aa, Artificial Sequence
  Description of Artificial Sequence: Synthetic peptide
QQLNHYPIT

SEQ ID NO: 672 - protein, 494 aa, Artificial Sequence; identical to SEQ ID NO: 319
  Description of Artificial Sequence: Synthetic polypeptide

SEQ ID NO: 673 - protein, 491 aa, Artificial Sequence
  Description of Artificial Sequence: Synthetic polypeptide
MALPVTALLLPLALLLHAARPEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 674 - protein, 531 aa, Artificial Sequence
  Description of Artificial Sequence: Synthetic polypeptide
MALPVTALLLPLALLLHAARPQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 675 - protein, 528 aa, Artificial Sequence
  Description of Artificial Sequence: Synthetic polypeptide
MALPVTALLLPLALLLHAARPEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKGSGGGGSCPYSNPSLCSGGGGSCPYSNPSLCSGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 676 - protein, 574 aa, Artificial Sequence
  Description of Artificial Sequence: Synthetic polypeptide
MALPVTALLLPLALLLHAARPGGGGSCPYSNPSLCSGGGGSGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 677 - protein, 571 aa, Artificial Sequence
  Description of Artificial Sequence: Synthetic polypeptide
MALPVTALLLPLALLLHAARPGGGGSCPYSNPSLCSGGGGSGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKGSGGGGSCPYSNPSLCSGGGGSELPTQGTFSNVSTNVSPAKPTTTACPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 678 - protein, 532 aa, Artificial Sequence
  Description of Artificial Sequence: Synthetic polypeptide
MALPVTALLLPLALLLHAARPGGGGSCPYSNPSLCGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 679 - protein, 529 aa, Artificial Sequence
  Description of Artificial Sequence: Synthetic polypeptide
MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKGGGGSCPYSNPSLCGGGGSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 680 - protein, 527 aa, Artificial Sequence
  Description of Artificial Sequence: Synthetic polypeptide
MALPVTALLLPLALLLHAARPGGGGSCPYSNPSLCGGGGSQVTLKESGPVLVKPTETLTLTCTVSGFSLSNARMGVTWIRQPPGKALEWLAHIFSNDEKSYSTSLKSRLTISKDTSKTQVVLTMTNMDPVDTATYYCARIRDYYDISSYYDYWGQGTLVSVSSGGGGSGGGGSGGGGSGGGGSDIQMTQSPSAMSASVGDRVTITCRASQDISNYLAWFQQKPGKVPKRLIYAASSLQSGVPSRFSGSGSGTEFTLTISSLLPEDFATYYCLQLNSFPFTFGGGTKVEINGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 681 - protein, 524 aa, Artificial Sequence
  Description of Artificial Sequence: Synthetic polypeptide
MALPVTALLLPLALLLHAARPGGGGSCPYSNPSLCGGGGSEVELVESGGGMVQPGRSLRLSCAASGFTFSDYGMHWVRQAPGMGLEWVTVIWYDGSNKYYADSVKGRFTISRDNSKNTVFLQMNSLRAEDTAVYYCARDEVGFVGAFDIWGQGTMVTVSSGGGGSGGGGSGGGGSGGGGSDIQLTQSPSFLSASVGDRVIITCRASQGINSHLAWYQQKPGKAPKLLIYYASTLPSGVPSRFSGSGSGTEFTLTVTSLQPEDFATYYCQQLNHYPITFGQGTRLEIKGGGGSCPYSNPSLCTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 682 - protein, 40 aa, Homo sapiens
GRKKLLYIFKQPFMRPVQTTQEEDGCSCRFPEEEEGGCEL

SEQ ID NO: 683 - protein, 112 aa, Homo sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

The invention claimed is:

1. A chimeric antigen receptor (CAR) comprising an extracellular ligand-binding domain that specifically binds to CD70, a first transmembrane domain, and an intracellular signaling domain, wherein the extracellular ligand-binding domain comprises a variable heavy chain domain comprising amino acid sequences for CDRH1, CDRH2, and CDRH3 and a variable light chain domain comprising amino acid sequences for CDRL1, CDRL2, and CDRL3, wherein
the CDRH1 comprises an amino acid sequence selected from SEQ ID NOs: 97-99,
the CDRH2 comprises an amino acid sequence selected from SEQ ID NOs: 100-101,
the CDRH3 comprises the amino acid sequence of SEQ ID NO: 102,
the CDRL1 comprises the amino acid sequence of SEQ ID NO: 217,
the CDRL2 comprises the amino acid sequence of SEQ ID NO: 218, and
the CDRL3 comprises the amino acid sequence of SEQ ID NO: 219.

2. The CD70-specific CAR of claim 1, wherein the intracellular signaling domain comprises a CD3ζ signaling domain.

3. The CD70-specific CAR of claim 2, further comprising a second intracellular signaling domain.

4. The CD70-specific CAR of claim 3, wherein the second intracellular signaling domain comprises a 4-1BB domain.

5. The CD70-specific CAR of claim 1, wherein the intracellular signaling domain comprises a 4-1BB domain.

6. The CD70-specific CAR of claim 1, further comprising a stalk domain between the extracellular ligand-binding domain and the first transmembrane domain.

7. The CD70-specific CAR of claim 6, wherein the stalk domain is selected from the group consisting of: a human CD8α hinge, an IgG1 hinge, and an FcγRIIIα hinge.

8. The CD70-specific CAR of claim 1, further comprising a CD20 epitope.

9. The CD70-specific CAR of claim 8 wherein the CD20 epitope comprises the amino acid sequence shown in SEQ ID NO: 293 or SEQ ID NO: 294 or SEQ ID NO: 609.

10. The CD70-specific CAR of claim 1, wherein the first transmembrane domain comprises a CD8a chain transmembrane domain.

11. The CD70-specific CAR of claim 1, further comprising another extracellular ligand-binding domain which is not specific for CD70.

12. The CD70-specific CAR of claim 1, wherein the extracellular ligand-binding domain(s), the first transmembrane domain, and intracellular signaling domain(s) are on a single polypeptide.

13. A polynucleotide comprising a nucleic acid sequence encoding the CD70-specific CAR of claim 1.

14. An expression vector comprising the polynucleotide of claim 13.

15. An engineered immune cell expressing at its cell-surface membrane a CD70-specific CAR of claim 1.

16. The engineered immune cell of claim 15, further comprising another CAR which is not specific for CD70.

17. The engineered immune cell of claim 15, further comprising a polynucleotide encoding a suicide polypeptide.

18. The engineered immune cell of claim 17, wherein the suicide polypeptide is RQR8.

19. The engineered immune cell of claim 17, wherein the suicide polypeptide comprises RSRQR or R2S.

20. A pharmaceutical composition comprising the engineered immune cell of claim 19.

21. A population of cells of claim 15, wherein said population of cells comprises a percentage of stem cell memory and central memory cells greater than 20%, 30% or 40%.

22. The population of cells of claim 21, wherein the population of cells achieves lysis of greater than 20% of CD70 expressing cells at day 6 upon repeated exposure of the population of cells to CD70 expressing cells as measured using the assay disclosed in example 4.

23. A pharmaceutical composition comprising the engineered immune cell of claim 15.

24. A method of engineering an immune cell, comprising:
a) providing an immune cell; and
b) introducing into the cell at least one polynucleotide encoding the CD70-specific CAR of claim 1.

25. The method of engineering an immune cell of claim 24, further comprising introducing at least one other CAR which is not specific for CD70.

26. The CD70-specific CAR of claim 1, wherein the CAR comprises the amino acid sequence of SEQ ID NO: 619.

27. An engineered immune cell expressing at its cell-surface membrane the CD70-specific CAR of claim 26.

28. A pharmaceutical composition comprising the engineered immune cell of claim 27.

29. The CD70-specific CAR of claim 1, wherein the CAR comprises the amino acid sequence of SEQ ID NO: 628.

30. An engineered immune cell expressing at its cell-surface membrane the CD70-specific CAR of claim 29.

31. A pharmaceutical composition comprising the engineered immune cell of claim 30.

32. The CD70-specific CAR of claim 1, further comprising a suicide polypeptide.

33. The CD70-specific CAR of claim 32, wherein the suicide polypeptide comprises RSRQR or R2S.

34. An engineered immune cell expressing at its cell-surface membrane a CD70-specific CAR of claim 33.

35. A pharmaceutical composition comprising the engineered immune cell of claim 34.

36. The CD70-specific CAR of claim 1, wherein the light chain variable domain comprises the amino acid sequence of SEQ ID NO: 17 and the heavy chain variable domain comprises the amino acid sequence of SEQ ID NO: 18.

37. An engineered immune cell expressing at its cell-surface membrane the CD70-specific CAR of claim 36.

38. The engineered immune cell of claim 37, wherein the engineered immune cell further comprises a polynucleotide encoding a suicide polypeptide.

39. The engineered immune cell of claim 38, wherein the suicide polypeptide comprises RSRQR or R2S.

40. A pharmaceutical composition comprising the engineered immune cell of claim 39.

41. A pharmaceutical composition comprising the engineered immune cell of claim 37.

42. A chimeric antigen receptor (CAR) comprising an extracellular ligand-binding domain that specifically binds to CD70, a first transmembrane domain, and an intracellular signaling domain, wherein the extracellular ligand-binding domain comprises a variable heavy chain domain comprising the amino acid sequence of SEQ ID NO: 18 and a variable light chain domain comprising the amino acid sequence of SEQ ID NO: 17.

43. An engineered immune cell expressing at its cell-surface membrane a CD70-specific CAR of claim 42.

44. The engineered immune cell of claim 43, wherein the engineered immune cell further comprises a polynucleotide encoding a suicide polypeptide.

45. The engineered immune cell of claim 44, wherein the suicide polypeptide comprises RSRQR or R2S.

46. A pharmaceutical composition comprising the engineered immune cell of claim 45.

47. A pharmaceutical composition comprising the engineered immune cell of claim 43.

* * * * *

UNITED STATES PATENT AND TRADEMARK OFFICE
CERTIFICATE OF CORRECTION

| | | |
|---|---|---|
| PATENT NO. | : 11,396,551 B2 | Page 1 of 1 |
| APPLICATION NO. | : 16/264371 | |
| DATED | : July 26, 2022 | |
| INVENTOR(S) | : Srivatsa Srinivasan et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 159 days.

Signed and Sealed this
Eleventh Day of February, 2025

Coke Morgan Stewart
*Acting Director of the United States Patent and Trademark Office*